United States Patent 10,724,096 (METHODS AND COMPOSITIONS FOR INHIBITING AND TREATING NEUROLOGICAL CONDITIONS) - sequence listing, part 73

SEQ ID NO: 1521 - DNA, 3491052 bp, Homo sapiens (residues 1,745,527-3,491,052 of 3,491,052)
gggttttgtcatgttgtccaggctgatcttgagctcctgatctcaagtgatctgcgtgccttggcctcccaaagtgctgggattacaggtgtgagccactgcgcccagccttaatgtgcatatagtacaaagctcattttttgattaaaaacacaataaatataaaataataataaaagtcaattaacttttattatttgaatttttagcagacacattgcaccttgtactttttaaaaatagcatctactcaactttattttttatgtgttttttttaatacaaaactccggaccttatttttctagtttttccacgaatgctccttttctgttctgggaccctgtgcaagagattccgttgcatttagtctcaggcctccttagcctcctctggtctgtgacagcttttcagtctttccttgtttttcatgaacttgaccattctgaggaggactggtcaggtattttgttgaatgttgctcagtttgggttgtataaagtttttcctagtgatttagactggaataatggatttttaggaggaattgcacagaggtacatgctatcaacatggcctatcactgatgctgaccttgattgtggaattaaagcagtgtctgccaggcctctccactgtccctttccttccttccttccttccttccttccttccttccttccttctttccttctttccttctttctttccttcctttcttccctccctccctccttcccactttctttcctttctttttctttctttctctttctttctcttttctttctttctttctttcttcctttctttccttcttccttccttcctttctctttctttcttttcttctttccttctctctctccctctttctttctttctttctctttctttccttcttccttccttactttctttctttcttttctttctttctttctttctttctttctttctttctttctttctttttctttctttcctctttctttctttccttttcttcctttttctgtcttctttccttctctctctccctctgtctctccctctctctttctttctttcttcctttctgtctctctttctctctctctctctccttctctctttcttttccttttcttttctttgacatggtctcactctgtcacccaggctggagtgcagtggtgtgattctagcaacattatccagttatttttaccttccctggcctcccatcccaaggaaaaaagagccaggaaggccttggctggaagcccttctgggctgcagccttgacctttgggctcaagcaatcctctctcctcagcctcctcagtagttaggactataggtgtgcactaggatgcccagctaatttttttatttttactttttgtagagacaaggtcttgctatgttgcccaagctggtctgaaactcctggcctcaagctgtcctctgcctcagcctcccaaaatgctgggattacaggcatgagccaccgcacctggtcctatttcccttttctagactcaagctatactccatatttattggaagccagttactaagacccgcttacactcaaaaggagtggaatcggtaagtgtggggtgtctacagatattatttaaagttctttgttaggaagacttgcctcttttaccccagtacattaatttattcaatcaatcatttattttatactttgggttttaaccttacactgtgttatttattttgttgctcaaattgttccagctttaatcatagtgagttttgggccttgcattcctgtgataagctgtcccttcctttttttttttttttttttgtttgtttgtttgtttgtttgttggagacagactcttgctctgtcacccaggctggagtgcagtggtgcgatctcggctcactgcaaactctgcctcccaggttcaagcaattctcctgcctcagtttcccgggtagctgggttacaggtgtctgccaccacacccagctaatttttgtatttttagtagagacagggtttcaccatctctactaaagagactaggctggtcttgaactcctgacctcaagtgatccacctgccttggcctcctaaagtgctgggatgatgggcgtgagccactgtgcctggcccgtccccttgtttttttaaagcacgtctttacttttcgtcactacaagatgctgcaggctcatcttgtattttctctgtcccagaccacaaacagccatttctccaaggagccatggttcctggagaataatagtgagaaatgaagactgggatgtggtgacaaactttaattttattgctctgtaagctttcccaagctccccattgggctataaacctcattctgcgtggtggttttgctgtctctctcaccatgttgcctcttgtacatacaatatctagtatttattgaatgaatgaagttcattgaaacaagttttagcttttttcttgattcttttaatattacactaattttacttttgtgtaacgccgtaatctagctagaccaagaaaatgagtcatgcctgattattattattattattattattattattattattattgtttgatgtggggtctcactctgtcacccaggctggagtgcagtggcgcaatcttggctcactacaacctccacctcccgagctcaagcgattctcccaccacagcctccagagtagttgagactacaggcgtgtgccaccacgcctgactaatttttgtgtttttgtagagacagggtttcgccatgttgctaaggctggtcttgaactctcggactcaagtgatcctcctgcctcagcctcccaaagtgctgggattacaggtatgagccaccacacccagcagagtcatgccttattttatctccctgtcattatgaaatgactgatatctcagaaaatgaagacatgaatgcatttgtaatgtattcatggagtatgtcctaccctgcatgcatttcaacagtagtcacccataatcaatgaatatttgtaattcttggttatttgattttattcctggccagaaatttaaaaaggaaagtgtgtagtaggaaaaaaaaaaaaaagcaaattgactgttttttcctactacacttactcaactccatgcacttctgtgaccatatgggtggggttttccttacatgtcagtactcccatgggtaccaactgggtatcctctaattcagttcaattctgacattatatacttggagtcagatcccacaagataaggactcagtcccacaagtctgcttccacctcagatgccaatagcaagtctgggcctctggaactgaccaactggctataaattaggggttcccaccaccctctccctaatgatttgctagagtggctcacagaactcaggaaatcaccatacttaatgtttacccatttattataagggatattacaaaggatacagatgaacagccagatgaaaaagatgaggcacagggcaaggtatggggagaggggctgtggagattccatgtcttctgatatagtgtggttgtgtccccacccaaatctcatcatgaattgtagctcccgtaatccccacgtgttgtgggaaggacctggtgggaggtaattgaaccatgggggcaggtttttcccatgctgtttttgtgatagggaataagtctcatgagatctgatggttttataaaagagagttcccccgcacctgctttcttgcctgccaccatgtaagaatgtgcctttgctcttcctttgccttccgccatgagtgtgatgcctccccagccatgtggaattgtgaatcaactaagcctctttcctttataaattacccagttttgggtatgtctttattagcagtgtaaaaatgaactaatacatcctgtatgggtaagacaccctccatgtgttcagaaacctagaagctcctcaaaccccttgatttttatggaggctttatcacataggtatgattgattattaagtcaatttccagcctctctccccttctcagaggatgggaatggggatggaagttccaagcttctattcttggcttggtctttctggtgaccagcccccacccagaagccccattgagagttcccatattagaacaagagatgctcccatcactcagaaaattgcaagggattaggaactctgtggcaggaaccagggttaaagaccaaatattggaacaaaagatgctcctaacatctctattgcccaggaaattgcaagggatttaggcactatctgccaggaactggagataaagatatatatatttcttattataaatcataatgtcacataaagatacattgttgctctgttcttttctaattcttttccttccatctatttccatatgtcaaaattggaccagtgtcccaaggcctaactaactccaaagccaagtctttccagttgcctttatatctctctgtctaaaatgagatctcccttatctctgaatcccatgagtttgtatttacactgtgatatttacctttttaaaattgtactcatttatatatgtcataatccttctctaacactgtaaattaatttctggcagggctcatatcagattcaacttcttgcctacaaatagcaacaagaaatcaattgtttaaagagaatttgaaatttaaaaaattatattatggctctgtaatagctaatttcagaatggaggaaaaagaacaactaaatcagttgatcagaaggaggggaaactatacaaattatgttctggctataaaattacaagtgattgttatgtagaggatagatagggaagctagtactacagtgaagttccccctttcattctcaaccccttaaatttggtccaaagaaactcaaccaaccaaccaaccaactaaaaaaaagtcgatacatttggtatcgaagaaggtatggtgaaaaggttaaatatatatagttgaagggggaagaatctggtctagaatgataaaagatgcacatacaagaaaatatattaccacgctgtttgcaaaaatgaaaaccagagcattttggaagcgacctgactgtctgtcaacagcaaatgactggataaaatttgatatagctatactatgtgatgttatgtggctattaaaaacaaattagatctctggctatttttccaaagacatgtctgtggtgggctgtaaagtgagaaaaggaaggagcagagacaggagttgagcttgattctagttttgtcaaaatgtcaacttacaggtcagggtaaggacctgtaagggagggaagagaaaacgggagggtaggagaccagccaggctagatagggacaaggttgcatgttctcccacaatgcgtccaggtagcctcttattctgaaaaagacacagtcaccttgccaacggccatgacctgctagtctcattgattctcataggaaagaaacatttgtgcccagagttttaggggatttgaggttccagttggggatttccctgaggagagcgcatgtcatcatgcattttgacgtcatggcatcttgaactttagataaaagagaaccaattcatgttgattttttgttgttgtggcatttaaaaactctgagctttatcttttagaggggtaagatgaaaaggagtgaagatcagccttcccctttttacttaatgggaaagggtttgtagatgatttaaaatgtcacttatttcattgaaatgaatgatacatttattaaagatgttcaaactcaccagtgtcagagatatgtaaattaaagtaacagtgagatatccctctcaggctgggaaaaaaaatggaaaagaccaatctcacctatattgttgatgggaatgagaattatttcagctgtgttttggccacatttattaacataaaatatatagatttttggaaattatataggactggatatataggaaataatataggtaataagacacataaattatatagaataatgataaaatgaacccatttccaacctaagaatgtggtcgtcaccaatactgttgaagccacctgcaagcttctctctagtccactttctctgccttctccgcctttctctagaggtatctactaccctgttctcttgctttgctcttttaaaaatagttaaagagaaatacatatactctttgaccccgtaatccccatcctgggactctatctcgtagacataaaggccatggtacataaggatgtttgtagaaaggatgtttattgcagcactgtttgtagtagccaaagagggagaaacgagtgaatgcccattaatgattgaacaaattacaggacatccacaccatggaattttctgcagctattaaaaaacgatgaattagagcaataccagatgccttggagggatttccatggcatattgtagaatgaggaaatgggagctgcggaagcgtgcataaaatgacaaatgcctatgtattatatactgtgtgtgaatacatatatttgtgtgtgatttatgagtatagagacaaatttggaaggatgtattctaaattgtcaatgaggattaacagaaagaggaagggtggtctgatgtggagggagaatggattaagccaaaagagaagaagaaaaaaacccaaattacctgggcttcatcagataaatggagatcaaaattccatcttattgttgttccagggcttgtaatatggttaggctttgtgtccccacctaaatcaaatctcatcttgaattgtaatccccataatccccacagatcaagggagagaccaggtggaggttattgaatcatgggggtggtttcctccttgctgttctcatgatagtgagtgagttctcacgagatctgatggctttataaggggctcttttcccctcttcgctcaggacttcttcctgccaccttgtgaagaaggtgctttgcttcctttttgctttccgtcatgattgtaagtttcctgaggcctccccagccatgctgaactgtgagtcaattaaacctctttcctttataaattacccagtctcgggccgttctttatagcagtatgaaaatggactaatacagcttgtgtgataatttcactggatgatgtgaaggcttttttgaaaatgttcaaggctctgcccaaatatgtgatggtggaatttattatgatatgcaaatgatacttataatagtgatgtgattttatttatttatttattttttttgagacagggtctcactctgtctctcaggatggagtgcagtggtgcgatcacagctcactgcagtctcaacctcctgggctcaattgatcctcccacctcagcctcttgagcaactgggactacaggcatgcaccaacacacccggctatttttttttttttttttgtattttttgtagtgactgggtccatgttgaccaggctggtcttgaattcatgggctcaggtgatcctcctgtcttagcctcccaaagtgctgggattacagatgtgagccactgcacgtggccagtgatgtgactttgagcaaataattttttattcttctaggtctaataaggttttatccattagacagataataataaccaacctcattaatagctgatatcctttcagatgaactattgaaatcactctgcctggattaaatgtagtcctcaaccatggcaaaattcaaagtatgacctgcttaacctgactgctaaatcctcccctgacccccaccacagtttcccctctgctaacaccttacatcgccatggtacttttgtctaaactcagagatgggaactggcgcattgcttgtaactaacctccagagtttatatggctttcacttttccaatcatgttctgtttctgttttacgatccaatccagggtgccacactgcattttgttggcatgaatcctcagtcatttcttgtctgtgacagtttttcattattttttatagctttttttttttttgagatggtgtcttgttctgtcacccaggctggagtgcagtggtgtgatctcggctcgctgcaacctccgcctcccgggttcaagcaattctcctgccttggcctcctgagtagctgggattacaggcatgcatcaccatgcatggctaatttttatatatttttttagtagagacagggttttgccatgttggccaggctagtcttgaactcctgacctcaggtgatctgcctgctttggcctcccaaagtgctgggattacaggcatgagccaccgcgcccggcctacgttttatggctttgatggtcgagatgtgctggccaggtatcctgtagaaagttccccgatctgggtttgctggatgccttctccagattatgctggagcagtttgtttttgtgtgtgttatccagactaatctcctcttggaataattttgcctatataaatgtgacccgccgggcgtggtggatcacacctgtatcccagcactttgggaggctgaggcaggttaattgcctggactcaggagttcgagaccagcctgggcaacatggcaaaaccccgtctctaagaaaatacaaaaaattagctgggcgcggtggcgcacacctgtagtcccagctacttggggggctgaggtggaggatggcttgactctgggagtttgaggctgcagtgagctgagatcatgccactgcacttcagcctgagtgacagagtaagaccctgtctctaaaaaaataagataaaataaaagaaatgtgaccctagagttgtgtgtgagtgagagagagagagagagagagagagtgtgtgtgtgtgtgtgtgtgtgtgtgtgtgtataagaggcagggtctgtctctgtccccaggctggagtacagtggtgcaatcatagctcactgcaaccttgatctcgtggtatcaagcaatcctcctgcctcagcctcccgagtagctaggactacaggtgtgcaccaccactgctagataattctttttttttctagacgtgtggtttcactatgttgtgcaggctgaaactcctggcttcgagtgatcctcctgcctcagccttccaaagtgctgggattacaggcatgatataccaggcctagcccctagaggtattaaatgggggtattaacttgtctttttattcttcatttaaatgattgcaaatgctatccaatctactcccgagaggcccctcagggagttagtttccattttacagatgaggcagccggacccttctgcatggcagagaggacattccaacccagatgccagtgccagaggctgcccatagctccgctactgttgagctgctaacaaattggtttgtccaagggcatgttcaactgtaaccctccgttcccctttggagaaacttcactatcacctaattaggtaacatggtaactgggcaaccattacttataatagacgtggagttgtaaattattctatttaattaagaactgcacatttcctattaaaggaaagcttatcataggttagtaaatttattgggaacacttaactttagctaattaagctgtttgaactcaaggcgagggcattcattaataaccaagcccaagcagttaagggcaattagtgaaacagctggtctttatctcactgttaaaggatggttaatagagatctttgcagctcttataaacctccccaaagcaatatcttcttcaaaagtttgcattggtaaagaaaatagaagaggaaactaaacataaaagaatggagtgtcggaagcagtctggatctctaggctcatgatgatgccagaaaaaaatgaaatccagaggcatttcctagtggtcctcatctttcctagtggtctgcatttacctgggagagtttgacctcgaagtcagcagtagatgtgttttagctcccccctggaatcttggctgccccaggagcatggggccagggatgggtcctttatatatgcagagattatatgtcctgaaagaaaaatgcaggaatggtaacctctcattcagaaatgcagccaggtagccttagacaaaatgctttttttggatctgcaaacgtctctatgtagaaagtctcacagagtcctcatatgtcttattcagtaatttgtcagatttttttttttttttttttttttggagatagggtctaactccgtcacccaggctggagtgcggtggcgcaatctcaactcatcacaacctcagcctcccaggctgaagcgatcctcccacctcagcctcctgagtagctggtactacgggcatgtgccaccatatcctgctaagttttttgtatttttaataaagacgaagcttcaccatgttgtccaggctggtcttgaactcctgagctcaagcgatcagcctcccaaaatgctaggattacaggcatgagccgccctacccagccagcttgaacttttatttagaaatgttaaaatgtgcatagttattaggattatcttgtgtttcaggaatcaactgtcattatgtatcctgtgattggagggaaatgagtaattcttaccctacctgcaaatagttgtttcttggtcagatggtagggattctggttggggatggtactttcatcactctgccttcagacatgtattgattgcctgttgtatgctgggcactatgctggtatgtgacatcacatgagagcatcaaggagcctgtttagcttgcaatccaatgagagaagaatggacagtaaacaggtgttgtttttgtttattaaaacaaggtaatctttggctgggtgcgatggctcgtgcttgtaatcccagcactttgggaggtggaggtgggaggatggctcaaggccaggagtttgagaccagcctgggaaacatagagagaccccgtctctacctaacagaaaaaattagccaggcatggtggtggcatatccctgaagtcccagctatttgggaggctggggtgggaaaatagcttgagcccaggaggttgaggctgcagtgaactatgattacgccactgcactccagcctgggtgacagagtgagatcctgtatctaagaaacaaaaaaacaaaaaacaaagtaatcatggactatgatcaatgctttgaaggcaaagtggttatccaaattcagcctttcttggttgttgccttgccttataatagtgtctgcttcatatttcctttttagttggctcatattgctttaaacttaaatatatttatttgaaatgaagaccttatattcctacaataagtgggaagccagtatcacttatcagaaatggaaactaatcagaagaataaatacataactattaaaatgaaagctgtcacatgttctcatttatacgtgggagctaaatgatgagaacacatggacacatagaagggaacaacacaccctttcagagggtggagggtgggaggagggagaggatcaggagaaataactaatgagtactaggtactgggtgatgaaatagtcaaacacccgtgacacaagtttacctatgtaacaaacctgcacttatacccctgaatttaaagtaaaagttaaaaaaattcattacctcacatacttagttttggagggttgaagacatttaaaatctactcttttagcaattaataataaaggttttttttttgtttttgtttttgtttttttttttttttttgagagggagtctcacactgttgcctgggctgaagtgcaatagtgtgatcttggctcgctacaacctctgccttctgggttcacgcgattctcctgcctcagcctcccgagtagctgggattacagtcccacaccaccacacctggctaattttttgtatttttagtagagatggggtttcactatgttggccagactggtcttgaactcctgacctcatgatccgcctgcctcggcctcctaaagtgctgggattacaggtgtgtgccaccatgcctggctatttttttcgtgtttttagtagagacggggtttcaccatgttggccaggctagtctcgaacacctgacctcaaatgatctgcctgctttggcctctcaaagtactgggattacaggtgtgagccatcgtgcccagcctaatattaaagttttctttggttttagtaaatgaaaaaaataaaaataaaataaaacctgtcttctgccacctaaaaacagcccaggaagtaccagcagtgtgcatgtcatattttggaaatattggcatgagttgaggggtaactgaggatgccacctgccatgtgtgcatgcatgtgtatgtatataaccacctgaaagtagattacatggtacttcactcttaaataatagtgtgcgttgtctaagaacaggaacttctactacataatcataataccatttcacacctgagaaaatgaacaatagagcctgatattatttaatatatagtccatattcatgctttcctcattggcccaaaaatatttttatagctttcttcttgaacccagatataatcaaggcttacacactgcatttggtcactaggtgtttttagtctaaatctataacaaagtttggtaatcattttctagaaagggccgggtagcaaatatttttggctttgcaggccatatcatctctgttgcagtcacttaactctgctcttttcatacaaaagcagccatggacagtaagtaaacaagtgaacatggctgtattccaataaaacattatttacaaaaacaggtagtgggccagatttggtccacaggataacaccaaactcacttccccttttaaatgaaattggcttaaaatccttccttttaaagttgcagcatgtggcattgacttttgaaaaatctcagccagatgtcttgtagaatgtcccacatttggatttgtccgaagtttcctctgggtgttattgaacttgttcctctctcccctatatttcttctgtcctgaagattagtttcagaggcttgatttgattggggtgaaacatttctggcaagaatccttcaaggtgatgccatatctttcacattgcatcatgccaggaaacatgtatttctttgctccccacttggtgatgccaagtttgagcccttggctagggacataacaccagacctctccattgcaaaggtacatttcccctctggaattagtgcataatatgcaggcttctccctctgtctggaacacgcctctctgtggtcttcctttgggtggctctttctcatcatttgagcccccactcaagcatcagctgccctgagagcaggacattatgcaactgctcttaggtgctctcaaggccctgcatgctgtggccctggccacctccctggagtcatcttggacattctcctctttcctgttgcaggtcagccatgctggccatctttcactgcatggagtgcaccgtgctccctctgtcctatccttgcctggagcacatcactctctgcctcacccggctaaccccttctcacacttctggtattcactagggggtcctatcctgaagggtgtcttcctagactgtcctccccatcccagtttgggcaaaatactgctgtcaaatgttctcaaagtaccacataagtttctttttgtaagggctcatcacaacggaaatttttcatttttaatgtggttattatattagtctcccctaccctccctagaagctgagctccataagggcaagaagcctgcctaattttgttcatccctgtaaatatccaaaacacctagcacagtgcccagcacatagtaggtgctcaataaatatctgttgaataaatgtatgaataatgacttgttgaatggctccaatgggaccctatgctaataggatcctgaagggtcagccctatttagcactcggaatgatctagaccaggaattggcaagctttttctggaaatggccagatagtaaatatttttagctttgtgggccatacattctctcacggaattattcaagttggttgtggtagtgaaagcagccaggggaaatacctaagtgaatggacagagctttgttccaataaaaatttatttacaacaggccaggtgcagtggctcatgcctgtaatcccagcactttgggaggctgaggagggcagatcagttgaggtcaggagttcaagaccagcctggccaacatggtgaaaccccatctctactaacaatacaaaaattagccgggcatggtagcatgcacctgtaatcccaactattcagaaggcggaggcaggagaatcgcttgaatccaggagatggaggttgcagtgaacttaggtcacaccactgcatcccagtctggatgacagagcgagacttcatctcaaaaaaaaaaaaaaaaattacaataggaggcgagccagattggggctgtgggatggagttggccagtccctgatctaggggcattattcctggtttcatcttaattttgcttcatatttattgaattcctgctctgtaacaggcatgattctggattctgggaatatcacagtgagtgagactgacaatatctttggccacatgaagcttactataaatgaatgaatatttgactagagacagacaataaagaagtaaatgaataatatcatttcacacatgatgatgtgttccatgaaaaataattaaactgggtgctggaatgctgaatgactgagttgaagcctaggggctgctcttttaaatagaatggtcaggttaaattaggggcaatttgagcattggtaaaaaggatgtaactgaatgtcgcacactggagaaataaaaacccatgagtcaatagtgtgtctaaagagaaagggagaagtgaaggaggaaagctcttagttagggagctaactaatccttgtaaaaggatcggtagaattaaaaatcatggccaggagtggtggctcgtgcctgtaatcccagcactttgggagactgaagtggatggatcacttgatcctagaagttcaagaccagcctaggaaacatagtgagaccctcattactactactaataaaaaatattatccaggcatagtagcacacacctatagtcccagctatttgggaggctgaggagggaggatcgcttgaacctggggaggctgaggctgcagtgagctgtgatcgtgctactgcattctggcttgggcaacagagagagaccctgtctctaaaaaaaaataataaaataaaaatcatgtttcaagccccattgtaataattgattcatgaccagcctgggcaacatggtgaaacccgtctttactaaaaataaaaaaaattaggtaggcatggtggtgcacacctgtggttccagctactcaggaggctgaggcagaaggatcgctcaagcccaggtggtggaggttgcagtgatccaagatcgtgctgctgtactccagcctgggtgacagggtaagactttgtttcaaatgatactaatactaataataattgattcatgtaagaatcatcttccccaagaaagtacaattgagcaagagaagaatgatgagatgaagccaccaggaagaaagcgtggggaagggtgttgcaggcagagggaggggacagtgcagtccctgtggcttgcttcagagacagcaagaagatctcggttgctggacagaggaggagaatggtcagagatgacagacccagggcatgttgggctttgtaggtcctaaggaggagctaggattttatcctaagtgtggggggaaaccatgacagtctttggaatggaaaggaggtaagatggtttctattttaacatgattctgcctgctactgtggcaggagtaggttggcaatggggtggtcacagtggaagagggagaccagcaaggggacttccaaagtcatctgatgcaagaaatgatgtggtgtcagcagaaggggtgagaagtggttgcagctggcatatacatttgaaggtagaactcccagggtttgaattatatgtggatgggaaggaaagagaggagttgaggatgactccaaggtctcgaggctgaataatctgtgggtgggagccatgttgggggaagaccctcagaggcctcggtttatgaaagaagcctcaacaactgtattatgatggatacatgccctgtgtgagatgcctgttagacatctcagtgacatggagtaggcaggtgtaggaggtacgagcctggagatagttgagagttattggtctatagctgattaaatcacaagaggggataagatcccttagatagaggagacctaggattgggaaaggcattaggggacacagaaggggcagctggttaggtaggaaaaccaggaggatgggaaccctagcaccagttcagaaagaatttcaagaacttagttcccttatttccccttattgtattttttcacccctttaaaactcattttggcctgtagcagtggtaaacaatagctctgacagtagtaacagtaaaggcagccagcatttatacctgttctgtgccacacagatgctaaacaccttacctgctctatctcattgaatcctcactccagctccttgatgtgggctttattattatccctggtctaaactgagcaaagtgaggcccagagaggttgagtgacttgcccaaagtcacacagctcataagtgacagagccagaattagaaccctacatgcctcaaatcttttcccaaaataggttagctataaataaatgtcctgagaagctcctgggaaaagggtagtggttgatgggaggacattcactctggtatttaaggaactgctattcatcagtccagaaacagaatagaggcagacaatacaaaattcctgctcttctgggggagcctcagtatcctcatctgtgaaatggggataataaatatatctacctcatcaactttttgagaggattcaatgtgttaatgcaacaaatctctcagaacagggcctaacatgtagttgacatacgagacatagtcattattgagagactctatggcttcatggttaaggattgggcctcctagtgccaggatgtctgggttcaaatcccaactttgctactccctagctgtgtggcactgggcaaattccttaccctctctgtggcttaatttccccatctgtaaaatgggataatgatagtttgtagctcatatcattatgatgaaggtttactaagctaatattttgaaagggcttgaagtagctggtacatagttctcgtgttttagctgttatcatggggttgggatacagtggggacacaggcaacaagcacgcctgtcagtaaagaaacatgttatcatctgtgagaagaaagcatggtaaataaaaaccctgctggatttccacgtgcgtttccgtgacaggcggcctggattaaagagtcgagaagtcacagcgggaagagctgtcctgttcccagaggcaaatgacagcccacggaaagaaatagcacaaagcttcaggacggggagacggtgtcccgaggaaagagaggaggagcagaggatgctgcgaatcactgtaatattttccctaggaaagtcccaggggttcttgtagaggccttaatctcctattctgggcttcggatgccggtagctccttgctctttgagagctgcgttccctctggcctctgtctgtctctgttagagcctaatcatatttgaaagtagtttttatctgtgattattcatctgtatatgaggagcttatgtgtctaagctgccacttccatcaaatccaagcgcacggccccgttaatacgcacaggcctgacgttggcagggaaagtggtccccacccctagtccaaggagggagattttagagagttacagggggccagctttgggagtggggaggtggaggtagacagtgctggcatcaagacagggagcaaaacaaatatgagagacctaatagcaggaattccagccaggcccgtaaatcgataggtgggcttaccctcaaggcatggcttctcaaactttaataagatggtgtctatgaagattacatattagcttagagaacaatatttcatttttgctggctctttttaatctgcgggagatgatgtgctgggctaggtttaatgctcacacacatatttcagtttaattttctgttaaattgtggtgaggttagagtggagttttttcccctcttcccagggtggggagttctgacatcaggaggcagacagccagcggggaatcaggccaaggacaaagttgggcggccccccgacctacgacaaagacaaaatcatttgattatccttgcttctcctgcggatgtttgtttctttctctctctctcttttttcctacagcattgcgatgtaattcacataccatgcaatttactcatttaaagtgtacaatctgtccaggcacggtgtctcatgcccgtaatcccagcactttgggaggttgaggtgggaggattgcttgagcccaggagttcaagaccagcctgggcaacaaagtgagaccttggctctacaaaaaataaacaaaattagctgggcgttgtggcacatgcccgtggtcccagctacttgggaggttgaggtgggaagatctcttgagcctgggaggttgaggctacactgagccgaattgcaccactgcactccagcctatacgacagagcgggaccctatctcaaacaaacaaacaaagaaacaaacaacaacaacaacaaaaaaaatggaggcttgtgtactgtatgtttacacatttaagcataaaccaatatatgtcatatcctcttaccttggcaaaactccataatgataagattaaaacatacaatagagctaaggtttagctctaatgttactggaagttgacacaatatcaaacatcactcaattaaacccctgttatttttggatattctgttggtggactggctggcaatgtttggatgaataaaagaaaaaagacacatataattcacaaattagatatttcataaaatttctttctctggctttaattttatcaaagtcactaataatgttgcttttgagaccgagtcttactctgtcgcccaggctggcatgatctcggctcactgcaacctctgcctcttgcgttcaagtgattctcctgcctcagccttcagagtagctggaattacaggtgcaagccaccatgcctggctagtttttgtattttgagtagatacggcatttcgccatgttggccaggctggtctcaaactcctgacctccagtgatccacccgccttggcctcccaagttgctgggactacaggcatgagccactgtgcccagccaataatgtttttataatcaagagttctaccaatttgcttctattgacagcaatgatttagtcattacaaaataaaatattattggattaaaactatttggatatattttcaccaagaaagtatatcatagtaaagataaaatggaaaaattaaagttatttttcgtatatgttttcaaaacattattttttctttaggtatttgaaattatttattacaattaaaaggtacaatgaaaattatgttagtattaacaattaaatattaaacaattaaaaaaatgaaagttgaaatttaatttttgaaatttgatttagatcttattacatatttttatttaaaaactattcataattctagttttctatgtctgttcagttgtcagtttcaagagtcattcagtattatggccagatttatgaatatacataattaagagtacattttttttgaaacagggcatcattctgttgccaaggctgaagtgcagtggcacaatcatggctcgttgcagccttgaccctctgagctctatcaatccttctgccttagcctcctgagtagctgagactacaggtgtgcaccaccacgcctggttaatttttgcatttttgtagagatggaatttcatcatgttgcccaaactgttcttgaactcctgggctcaaacaatcctccagcctcggcctcccaaattgctgggattacaggtgtgagccaccgcacctggccatgaattctttctactgcaacattttccgtggccgtaatatgcaactgtcaaaaatgccatactgattctagaaccacaaattagaacacaaagagaagcaagaaacaggcagtcagcactatggggaaatgatgttctgctctgcaagaatctattacccactctatttgagaggaaatatttgacaagttaatttgtccttttctttcctaagtgcttttgtgacccctgcacaccagagcagtacccatctctcctttaggctgtagtactgcacatgaaccttcaaggtgtttgggcacagttgccttttgttttgaggacagagatcaagatctgggaggcagtgcttctctggggcctgaatggtgttatgtattagggtgggtgtttggagtaatcaatgcgttttgtcagggctaggtccaggtcccaggtgactgagtggcccaggacaggagcccctgttgctcaggtctaagggtggccttgcagatgtatgtggggagacagaggttcagagaagaacttcaggactgaaacacctggatagcatctcggaatgcataaaccatccctttggatgcctgtggaaacttctctccatatttcttatctaaatggtgttttctcaacttctgatttgaccattctgtgaataatcctaagggttgaaacttttatgagttaagtggtgataggcttttccattttatttgaggatgcaagcattattttcctaacagacagttttcatctgtgggccaaaagcattgtcacaggtacatattctgaaatattcttatctacagataaagaactcagcacacacggtggtgtttgaataggaaaagtgaaaaacaaaccattcacctcacgtgatcaattttatttgggccattagcagagaatattttgcactagagacttcttacatcaagtaataactgaatgttaagcaaacagatcatcaattattaagatgcagctgctattaacataatcatttacatttcagtaatatcagcatttggagggggttgtaaagctacttaaaagcatctgatgtacaaaataggaatttaaccatgttccctttgctaaaattttttagaggatctagctctaattttccacttaagaatgggtgttgtgattgggagaggtgtaaaatctgatgtagaaatatctgatctctggatacctttttttaattggtgaaactcaggatgacttccttttgtgaacacattttcattcattcattcattcattcattcattcattcattcattcatttaaaagagccagggtcttgctcgtgatccaggcaggagtttagtggtgcaattatcacttactgcagcctcgaactcttgagctcaagcaattctcccacctcagcctcctgagtagctaggacgacagacacataccaccatgactggctagtttttaattttttttgtagagatggggtcttgctctattgcccaggctggtctcaaactcctggcctgaagcaaccctcctgccttggcctcctaaagtgttgggattacaaggcatgagccactgcacctggtctatatttttggaatatagataatacattcatatggctcaaaaagtaaaaagtaaaaaaaaaaaaatacagcgaaaacccttccttctttctctgtcttttttggcctacagtgctccgtccccagaagtaatcactgacgtcatgatcatttttatgtacctgttcagggtttctttgtatatatcagcaaatactaattttgactcatttcacacagttttgagccgtgggtcttttgcttttgtttcttattttccaatatatcctggagattattccaaatcagcacatagagagctccctcattctttatttccagccccatactacctgttgtaggttgtaccatactttatttaaccaatctgctatagagggacattggattttttccaactatttcttaggccaaacacattgtaaggaataaacttgtacttgcatgaggcacgtgcatatacttttacatatatttaggataaatttctagaaatggaatttctgggtcaacttttcatgcatatgtaattctgatagatgttgccaaattatcctccatggtgatagtagccttttgcgattccactagcaataaacgagagtgcctgtttccccaaggctggctcatgttttgaagacctgctcaagtagaggctatctgctcagcaccgacttgcaggggagaatagcattgttttattcgtattctccaattactctgctacttttcactccttgccttttgcttgctgtatgactgtgccttagtttcctcacctgtaagatggggctctaagaatacctacagcctacagtagttgggagagttccaggtgctaatgccaacaaagcactaagcacagttcagacacagtaactgcttaaaaatgctgttattaagagggtcaactacatgacaccacccagagattattgcaactctgcttctcttaggccacagcagacatgaatgtccatgttgtaaaataacaaaggcactgaacattttcttggaagaagaggaattttggttctaggtaaatgtgagccccctctgttgggtgtaattggagaagaggaaattggaggttttgagtggaaaagagtggtaaggaggatagtgaagcagaagcagatatttctgcaatgagccttggaggcggaaaacaaactgatgcctgagagagctttggcactgaaacccctgtctataggaggaggttcctgaactctgtgtgtcacaggtgctgagtgccccaggtattaaccggcctgaagttatcacctggacagctaaggctctagaatctgagtattgaggagactggagacagagctactcacccgggccaagtggaattggcagcatagctttatggttggaggctttttgtctggaatcaggcagccctgagttcaaatgctgcctccatcacttgctagtgggctggcctaggataagttcatgtttctgatcctcactttcctcatcggtcatctgaaggtaaatgccagagtagggggcattcttaagatgcttgtattttcacagggaggctcggggattacaggctggaagagttctaagacacttagcactatgcctggcacatcttaaacacttaataaatgtcagcagctattaaggatatcacatgaataaggttttacaagcgtgctgtttctgggatacaagggggaccctgaggggtgcatgttaacatattcaagttgtaaaaccagaaaagacccatttagatggctgtacagttatagagaggaaaaatgcctctcagcatacatgttatttgcaacaaagcaaaacaaatttgtgagcttcttattgcagatgaagcagagggagagcctgaaaaatttcctgccgtcttgaggcagtaaatagaaaatgggttgtatagtactgattgctgctaatttaagacatataaaaatcactgatggcctctttttgttctccacttttttctctgttatttactaaaggtaaaatagtcacacatttacatacattatctttgtccttgtaactcatttttatgttaaggatatatattccttattctatctctttcacttatttttgttccaacctaccattccctgtaagaatttaatccttgtgcttgggaatgaagtgtacaattctccttgcctagaatgctctaatctgcctgctgctatgcttggcaagctcttagtcctcaaccagctattacctttgcgaagtatttctcaagatcaccagcctcgatggccctttcttctttgattctgtgaggctctttttaatgtttcttttatagcatttttcatactgggctctcattctttgtgtacatatccgtctttccctttatactgggaaaactttgagtcaagagtagcatctctccctctcttccttcatcaaacatgtattaagcgtcagaccctgtgataggatctgtggatacagaaatgaattagacacagcccctggtctggaagggagatctcaagacaatgtgggagcaattaaagaacgaggcactgaggtaaaaccttacataatgctttcgtttagtcttccaaatgaccttagatgcatctgtgaggattcccattttaccattgaaaagcctgagctaaggagaaactataactcatgaaagaacataaggctaccaagtgttcacaattccagcctcaacgtggcccccctggaggaggcaaggcccagcaatgtcatgactgtgaggatttggccagatgaaggagtcaggggaaggaactccaggaagagagacaaggctatgcaaaggcttaggggtgagggagcattgctatttagggaattataaaagtattagtcatctcaggatttccggtgttcacacagtgctcagtacacagtagatgctcactgaatattgtaagaatgcattcctgccgctaaagtccccaaaacttgtaattcaactcaggacccgagtttcttgtgttcctcagtattcttcagtaaattctcatttttgctgaggttctggcttgcatagacccgtggcccaacttggaagagtgtgccctcaaactgtctccattcagcctttcagaaatacagttcagaggcttcctcccccacttctaccctttaaatgtccagggactgtttctacatttggttcagacagactgagcaaaattttggacatagatggacaattgctggatagacagctgatggagtgtcttgactgagaccgtctgtaggctacacagctctggggtatgtgaaaactgcccccagcagatggaagtctgagctcaagaaacaaaaatctaagggaagttgcttttagttcagccataattcctaactcttggatctctttctcatctgctctcctgcccatagacctggggaatactgttttagactggaaggggtggggcagatggagaaactgttctctttcttttgcttttgctgaagacatgttgtcaaggctaggaatgttctttcttttatatgggatgtcagttaatagaaaggactctggagccagactgcatggggtttgaatcccggctctgctacttaccagcttcttgaccttggataagttacttaacatctctgtacctcagcttccctatctgtaaaatgggattaataatagtacctatttcataaggtttttgtgagagtataaaggaattaaaatatttaaagcacttagaacagtacctggaacatcttacgtgcaatatatgtgacgatgatgattgtgataattaaagttactctacacaaactccctcctttcttctggttcatttgtactaaatggtaatgtcccatttagtctcaaagcccaatcaaataggaattagttcttattttctttgaagacatggtgaatttagactctaagttggtaatatcatgtttaagctgtctagcacggtaaaccaagaaaagaaaaacaaaataataagatttcagatgaaaatagttgggctattcacatgaacaaaataccccaggttgtttgagttgatatattactcaaaaccagaagaaacttgatctagtccacttactgaaattttgatgggtaaacggaagcacagagaactgactaatgcagggttatatagggctagacctagaatatacttctcctgatccctgttcatgttccttgcaatgccctgtagccaaaggatgttcactctctgaagcttctcaaatttttttttaatgataagggtcagcaaatgctttctgcaaaaggcctgatagtaaattattctgggttttgttggccatctgtctgttaccaccactcaactctcccattacagtctgaaagcagccatagacagcgtgcaaatgaatggatgtgactgtgttttaataaaattttatttataaaatatgtggtgggccagatttggcccatgggttgtggttgcaaatctctgctctatgatatccccagctgaagtgttaaagggaaataccagagcaataaatgctcttctacatgaaacagaagccattagccaaatgcttaatgtgaagaagtagccagaggaaagagctgtggtgtgtgaagtaatgaggatgattaggcaaaaaccagctttacttttccatcccagctaactcagtttctttttatttataattttctaaaagagggaaaatagagatggaaatttttctacctaaacagtgggattaagagaaaaaattctgtaatgtagttttggttaccatggcattcctggtacaacttgccagaacatccaaataaaaggacaagcttttatctctccctgcaactcaattaattttaatctataagatgagaattatccacttagcttccaagattagcttgctttattagggtatcaaaaaataagcagaaagaaaagaaaatgtgcttgaagatgacttgctttcatttgagaaaatcagtccacagttaattagggcaaaacttagaggctgcagggaggttagcagagtgagatttaatcattgtcagataagtgtacagtcaagaaaacaccatgaaacattctctctgtgaggtgcatagttacctacatcttttggaattgtttatgatggggatgtgtattagttatctgttgctacacgataatcacacccaaacttatcagcttaacacaaaacacatttgttgtctcacaatttccatgatcaaaaatgtaggcacaatttagttaggtgttctgtgtcaagagtctttggataaggctgcaattaaggttgtcaacctggctgaggtttaatttgaaggttctactggggatgaactcccttccaagttcccatggctgttagtagggttcagttcctcaagggttgttgtactgaggccctcagttcttagctggctgttgtctggaggctaccctcagttccttggcatggaggcctctctagtatgtcagcttgcttcatcaaaccatgcaagccaagaagacaatagagtctgctagcaagatggaagttacaatctttttttttttttttttttttttcctctggagacggagtcttgctctgtcgcccaggctggagtgcagtggcccaatctcggcaagtggagtgcaagctccacttcctgggttcacgccattctcctgcctcagcctcccgagtagctgggaatacaggggcccgccaccacgcccagctaattttatttttgtatttttagtagagacagggtttcatcgtgttagccaggatggtctccatctcctgacctcatgatccacccgccctggcctcccaaagtgctgggattacaagcgtgaggcactgtgcccggctggaagttacaatcttacataacttaattatagaagtgacagcccatcattgttgacatattctattgattagaagtaggtcacaggtcctgtccataccaaaaaaaaaaggaaccatgcaaagatacgaaggtgaagaggagaggatgatcgggggacatcttagagtctacctgctacaggaagagagaagtaatgatttcagtgaagtagtaatgagagaaagtacactgtcttgataagaagatctctgaagctgaatttactctgaaggatgttgtgatcattgagtatcatgggccaaagaggagggataacgtgtgcatatatcataccgttgctattcctaactacaaactctggtttctgagaagtttaaactgtagggagaccatttatcctcattaaatctagatgctgggctataacattgggtaaaccgagcccgtgtaacagttgggtctcttttagtgacaagcaacagaaaatccaactcaagtggttaaggaaagagagaatgtattagcttatacagctgaaaactccaagagtaaatttcacttcaggtgtagctgggttcagggcttcagcaaaatattttatttgtttacttttttggttaaggttattgagacgtaacttgggtatggtacccttttcgtacacagtttagtgagttttgataaacgtgcagttgtgtactcaccaacataatcgggatatagaacatttccacaatcccccctccctaatttttttcttgtccctttgtagtcaacttctcctgctaccctcagcccctgacaaccactcatctcttttcagtacctatagttttgcctttttcagaatatcttttaaatggaattaagtagtctagatgtactcataagattatgtgtctggcctctgttactcactatcctgcctttgtgtaggagtcatctgtgtaatcacacctctgatttctttttatcactgagtagcccattgtacagatgtacagtgatttttaaaacctattaaccaattgcaggacatttgatttgttaccatttttggcaactgtgaataaaactactagaaacgtttgtgcatatgttttttatttgtgtgtgtgtgaatgtaagttttcattgttctggtaaacacctagtagggaagttgcttagtgatacagtaaatctgtatttaattttataagaaactaccaatttgttttccaaaatgggttgtaccagtgctgggcacagtggctcacccctgtaatcccagcactttgggaggtagaggtgggtggatcacctgtggccaggagtttgagactagcctggtcaaaacagtgaaaccccatctctactaaaaataataaaataaaataaaataaaataaaagttacttcctattctcaccagtacttgttctcactcaccttttaaggtttattttagctattctaataggtgtgcggtgctatctcaaggtacttttaagttacattttcctgataactaatgatgtcagtcatccttatgtgtttatgtgctatctgtatgtcctccttggggaagtgtccatgcaaatcttttcccattttaataattgtgtacttacctattttgaggataaatgttattcttttttaaaattattattatactttaagttctagggtacatgtgcacaatgtgcaggtttgatacataggtatatatgtgccatgttggtttgctgcacccatgaactcatcatttacattaggtatttctcctaatgctatccctcccccagtcccccaccccccgacaggtcccggtgtgtgatgttcctcgccctgtgtccaagtgttctcattgtctggttcccacctatgagtgagaacatgcagtgtttggttttctgtctttgtgatagtttgctgagaatgatggtttccagcttcatccatgtccctgcaaaggacatgaactcatccttttttatggctgcaaagtgttccatggtgtatatgtgccacattttcttaatccagtcaagactgatggacatttgggttggttccaagtctttgctattgtgagtagtgccgcaataaacatacgtgtgcatgtgtctttatagcagcatgatttatagtcctttgggtatataccctgtaatgggattgctgggtcaaatggtatttctagttctagatccttgaggaatcgccacactgtcttccacaatggttgaactagtttgcactcccaccaacagtgtaaaagcattcctatttttccacatcctctccagcatctgttgtttcctgactttttaatgatcaccattttaactggcatgagatggtatttcattgtggttttgatttacatttctctgatggccagtgaagatgagcattttttcatgtgtctgttggctgcataaatgttttcctttgagaagtgtctgttcatatcctttgcctactttttgatagggttgtttgtttttttcttgtaaatttgtgtgagttctttgtagattctggatattagccctttgtcagatgggtagattgcaaaaattttctcccattctgtaggttgtctgttcactctgatggtagtttcttttgctgtgcagaagctctttaattagatcccatttgtctattttggcttttgttgccactgcttttggtgttttagtcataaagtccttgcccatgcctatgtcctgaatggtattgtctaggttttcttctagggttttcatggttttaggtctaacatttaagtctttaatccatcttgaattaatttttgtataaggcgtaaggaagggatccagtttcagctttccgaacatggctagccagttttcccagaaccatgtattaaatagggaatcctttccccatttcttgtttttgtcaggtttgtcaaagatcagatggttatagatgtgtggtgttatttctgaggactctgttctgttccattggtctatatctctgttttggtaccagtaccatgttttggttactataaccttgtagtgtaaagtcaggtgtgtgatgccttcagctttgttctttttgcttaggattgtcttggctctaaaggctcttttttggttccatatgaactttaaagtagttttttccacttctatgaagaaagtcatttgtagcttgatggggatggcattgaatctataaattaccttgggcagtatggccattttcacgatattgattcttcctatccatgagcatggaatgttctttcatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctttctgttcttggtgtacaggaatgcttgtgatttttgcacattgactttgtatcctgagattttgctgaagttgcttatcagcttaaggagattttgggctgagacgatggggttttttaaatatacaatcatgtcatctgcaaacagggtcaatttgacttcctcttttcctaattgaataccctttatttctttctcttgcctgattgccctggccagaacttccaatactgtgttgaataggagtggtgagagagggcatccctgtcttgtgccagttttcaaagggaatgcttccagtttttgcccattcattatgatattggctgtgggtttgtcataaatagctcttattattttgagatatgtcccatcaacacctagtttattgagaggttttagcatgaagggctgttgaattttgtcaaaggccttttctgcatctattgagataatcatgtggtttttgtcattggttctgtttatgtgatggattacgtttattgatttgcgtatgttgaaccagccttgcgtcccagggttgaagccgacttgatcatggtggataagctttttgatgtgctgctggattcggtttgccagtattttattgaggattttcgcatcaatgttcatcagggatattggtctaaaattctcttttttttgttgtgtctctgccaggctttggtatcaggttgatgctggcttcataaaatgagttagggaggattccctctttttctattgattggaatagtttcagaaggaatggtaccagttcctctttgtacctctggtagaaattggctgtgaatctgtctggtcctggactgtttttggttggtaagctattaattattgcctcaatttcagaacctgttattggtctattcagatattcagcttcttcctggtttagccttggaagggtgtatgtgtccaggaatttatccatttcttctagattttctagtttatttgcgtgggggtgtttatagtattctctgatggtaatttgtatttctgtgggatcggtggtgatatcccctttatcattttttattgtgtctatttgattcttctctcttttcttctttattagtcttgctagtggtctatcaattttgttgatcttttcaaaaaaccagctcctggaatcattgatttttttgaagggtttttttgtgtctctatctctttcagttctgctctgatcttagttatttcttgccttctgctagcttttgaatttgtttgctcttgcttctctagttcttttagttgtgatgttagggtgtcatgggagactttaacaccccgctgtcactattagacacatcaacgagacagaaggttaacaaggatatccaggactttaactcagctctgcaccaagcagacctaatagacatctccagaactctccaccccaaatcaacagaatatacatccttctcagtatcacatcccacttattctaaaattgaccacataattggaagtaaagcactcctcagcaaatgtaaaagaacagaaatcaccacaaactatctctcagacacagtgcaatcaaattagaacttaggattaagaaactcactcagaaccgcacaactacctggaaactgaacaacctgctcctgaatgactactgggtaaataactaaatgaaggcagaaataaagatgttctttgaaaccaatgagaacaaagacacaatgtaccagaatctctgggacacattaaaagcagcgtgtagagggaaatttataccactaaatgcccgcaagagaaagcaggaaaaatctaacaggggataaatgttattcttagatagaaccctcataagttgtttgagcaagtagaaacaacaataactagaaactgaggcttattttaaaaaaacctacacagccataaaaaagaatgaaatcatgtcctttgcaacaacatggatgtggctgaaggccattactctaagcaaattaatgcaggaacagaagaccaaataccacatgttctcactcatatgtaagaactaaacattgggtagtcatggacataaagatggcaacaataaacactggggactactgggtgggggagggaggaaggtgagtgttgaaaaactattgggtactatgcttactaccttggtgacgggatcagctgtaccctaaacctcagcattaaacaagatacccatgtaacaaacttgcacatataccccctgaatctaaaataaaagtcgaacttgttaaaaaaaatctaaaacatgtaaatgaacatagagctgcagagacataaaataacataacattagataaaaattgtattattgtttcattattgggctttgagagttttaaaaatatattccagatgtaaatcctttatcagatatgtattttgcaaatacttttatcccagtggcttgcatttttgaaacgtggcttgccttttaatatgttaacagtgtcttttgaggagcagaagtgtaaaatgttgatgaagtccaacttatccattctctcttttatggatgatgcttttcatgttctaactaataaatctttgcctaaatcatggtcataaaaattttattctatgttttcttctagaaattttatagatttagattttacatttagctttttaatccacttagagtttaatttttatataaggtgtttgttgaggtttagttctttattttttttttgcaaatagttatccaattcatcaccatttttgaaaagacaatcctttctctactaaattgcctcacacatttgtttttgttttgagacagagtcttgctctgtcacccaggctggagtgcagtggcattgtttcagttcactgcaacctccgcctcccaggttcaagcaatcctcccacctcagcctcccaaatagctgggactacaggtgcctaccaccacatctggctgatttttgtatttttagtagagatggggttttgccttgttggtcaggctggtatcgaactcctggcctcaagtgatctgcctgccttggcctcccaaagtgctgggattacaggtgtgaaccactgcgtctggccacctcacacatttctgaaacacggttgaccaaacaagcatgggtttccttcggggctttctatcctgacttttcctcagtgttggctccattttcaggaagactctttctcatggtttcaaggtgtctgacagtagctcctgaaacctcatttttcagtttcatgctcagtaaaagatgagcatctgtggcttggtattttccacaaaaatcctgaaattgattctaatccagaatgaatttcagtctgattagatcagtttaggtcatgtgatatggtttggatctgtgcgccacccaaatctcatgttcaattgtaatcccaatgttggaggtggggccaagtgtaaggggatgggatcatggggatggtccttcataatcatttagtaccatctccttggtgcttctctcatgagagtgagtgagttattatgagatctggtcatttaaaattgtgtggcaccttcccatcttttctctatatctagccacataagacataccagcttccccttccccttccgccatgattgaatgtttcctgaggtttcccaagaagcagaagctgctatgcttcctgtacagcctgcagaactgtgagccaattaaacttcttttctttataaattagctagtctcaggtattcatttgtagcagtgtgagaatagactaatatatcatgtgatacacagtgattgtcttggacctgggtcacctcctctacctgtgtgactaggaatggagcctcactcaaatcacacagaccttatatgtagaagaatgaattctcaaagaaaaactagggctctgttagaatgggaaaacatatgatgctgtgggcaaaaaacaatgcaaacaaacaatggcaaccaaacatcccaataaatatccatattgctcttaactcaagaatttcatgtgtaacagggaagaactgcatggaagaacacaaattataatagactgttcgaagtataacaacctaaataagtccaagatatcaatgagggagtaattaaatctatctgcatgttctgggaaggcttcccagatatggcctttgaaatgggtttaaaaatctttttaaaaaatacttaagtaaaatataatctatttaaagaaaagtgcacaagctataaggatatggctcaatatattatcacaatgtgaacatgcttgcataaccagcatctcaaaaatgccagtgtcctcttttctcaaaaagtaacttctatgctgagttttaacacagatactagtttttaccactttaaaaacaatataaatggaatcaagaaatatgaatcaacttgtctttgcttattttgtacgtggttatgagattcatccaggtatttgcatgtagccatagtcagttttcattgctgtgtactattccatcatgtgactatactaccatttatttattcattttattgttgtatatttatgttatttccagtgttttgactattatttaaagtgttgctatgaaaaaatttatatttaatttttggctatatgtaaatatagttggacatacatctagaatataaatttctgagtcatagaattagcatatgttcgaatgtagtagatgctgctaaacagttttctaaagtgcttgtgttaatttaaactcccactagaagcataatgggagttctagttcctctacattgctctcagtgcttgatagtgttagtctttttaaaattttagccattctagtgggtatgtagtggcatctgataatgattttatcttgcatttgccaaagactaatgaggttgaacacctttttatctgcctattggcaatttaggtatccttgttttgtgaagtatctgttgtttgttcaagtctttttttcatttttctgtagttttttgttttgatttagaaattattttgtaatctggtatgaatcccttttcatttacatgttgcaattatctcttcccactataaggcttaccttttcactttttttttttttttaaataagagaagggggtcttgctttgtcatctaggccagaatgcagtggtgtgattatagcttactgcaaccttgaactcctgggctcaagcaatcctcccaactcagcctcctgagtagctgggactacaggcatgtgccaccgcacctggctagtttttaatttttatttttgtagagatgggggtcttgctatgtttcctaggctggccttaaactcctggcctcaaacaatactcttgcttcagcctcccaagtagctgggattacaggcgtgagtcaccatgcccggcccttttcacttttgtaatagtgtggtttttttttttaatacacaagtgttcttaatttcaaaagtttaattttaaaattaaaagtttatcagttgtttgctttatgattagtactctgtgtggcttgtccaagaaatcttttcctccttaaagtaatgaagatagatacactccgatgttatcatctggaagcttgttttaccttctgcatctaaacctacataccatttgggatttggttttaggtatgatgtgaagaagggctcaagttttgtttttttaccatgttttatccagttgacccagcaccattttattgaaaagacttatttcttcactgttctgccattttatcataaatcacatgttaatagatgcaaaggtctatttctggactcaattatcttccattgtttgttttcaagccaacaccactttctttttcttttctttctttcttttttttgagtcggaatctcgccctgttgcccaggttagagtgcagtggcacgatctccgctcactgcaacctccgccttttgggttcaagtgattcccctgcttcagcctcccgagtagctgggattacaggcgcacgccaccacgcccagctaatttttgcatttttagtagagacagggtctcaccatgttggccaggctggtctcgaactcctggcctcaggtgatctgcctgcctcggcttcccaaagtgctgggattacaggcatgagccaccatgcccagccaccagtaccactttcttaatgtctatcattgtaataagtcttaatacctggtagagcgtttccttctactttgtcattctctaagattgtcttggctagtcttgactctgcctttacatataaatttaaaaatcggcttctaatttccaaaacaaacaaacagcacaggctgggaatttgactggagttgtattaaatctgtagatcagtttgcagacaattaatattactacagtgctactacagcatggagtcggagtcccccagtccaggaccttcgtttatcccttcatttacttaggtgtttaaacatttttatcaaaaatatcttagagttttccatgaagcagtcttgcacatattttgctagatttactcctggatatttgatttaaaaatatgattatagatggactttttgtttgctaaacatttattgatatatcaaaatacatttgatgattttgtatttattttgatcaactgggttttgaaatcttgctttctcttgggaagtaggttcatccatgtaccctaatatactctgtaggcctcccccgatgcactgcctatgggactcaaggttgccatattgcacaactccgggggcagcaatgacattgtaatccatgtagtcaggagaggcattatttatatacagtagaatatgatttgtgctctatgcattgtgtaaccttgactgccatgtaagaagtatatgagctgggcacggtggctcatgccttcaatcccaggactttgggaggctgaggcaggcggatcacccaaggtcagaagtttgagaccaacctggctaacatggtgaaaccccgtctctactaaaaatacaaaaattagccgggtatggtggtgcacgcctgtaatcccagctacttgggaggctgaggcaggagaatcacttgaactcaggaggcagaggttgcagtgagccaagattgtgccagtgcactccagcctgggaaacagagcgagactccatgtatattaaaaaaaaagaagtatatgaaaggtggcagatattgatagaattatcattcccatgcttggaaaattgtatttctttagtgactagtctatacctcactagaaggaaagactttttcctcttctagcctgttgtctttgagaaacaaaatagcattgccatatgtgagagctcctcctccttctccatagtctaactcctcctatgaatccaattacacttaaatcacctttggggtccaaagccaatgtagttgattcctgacttagcagggaagaatggaaaaccaatattatccaagaaacagggaagtgggaattgatctggatagcgatgttacacacagctgttcagtttgcacgctgcacgaaggctgctggccataagaataaatttggaggaagaaggctgaaatccagtagcactctgcccaccaagctgtgtgccttggcgtggggctgcatctatactcagggagcactttctcctaattcagctacccagatggggtatcgtttcccattttacacaaaggcaccctttaggccagtggatgccctggcccaggcctcgaagtttgactcatctccaagtcgatcatcagtagctgcatttatcagtttctcttggcacagatttgcagcattgccaggatgctgacaaaatgtttctagagaactccacgccctcttctaccctttctgttagtcttttattgattcttctctcttgtgtttctaagcctgagccaggaaccctcctgttattaaaagcagtcccagttgcccacacctttcatttcctttgaattacattaattgcctgacagctaaaaagtgagctggtattttcagatttcagcggctggtcggcaagaaatatttaccagctcctgcagatttataaagatgccatggagatgcctggagactaacaatcagaaaatacagcagcaaaacaacactatttttcaaggttaaatgctcagaatgctaaaaagaaattgtccataaagcaaaatagggattcagaagcaggcagcctctactctggacaaagaaaggagccagaggtttaaaataagatttcacagcttcacaataattatgaatttaataaggggagctttatttttaatttagtttcagtctggcagccagtctcctccctccaaccccctctctgcggcatggtagtgctctttaatgtggtcctaaggctaggtcacagtgagagctgggaagcgcccccagccataagactttctgatgaagaagaatttagacagataatgtttctgactctctgcaggcagatgggactaactcccactggctttactccctcctggcagccagaaatgtcttttgctatgtaggaagacactaggttctgaaaattccaagacaggaagatttttttcctcctggatagaaccctaggctctgattcctgttctccatgaacagaataataaaaccgagccaaggccactaagaatcattttagactctgctggtcaacaccatctccacttacaaagtctcgtttcatagaccacctttcagtatgagccgtttgccaagaccacatacattcctttgtttattgttcattcattctacaaacatttattgaaggtctattttttgaagtaccctgtgttatagaggttaaattcacatgacaaaattgatcattttaaggtgaacaaattagtggcatttagtaccttcacagtgttatatgaccacctctgcctttttccaaaatagcttcatcacccccaaataaaaacctgtacccattaaacagttactcttcatttttctctttccccagaaaggggtactaccaacctgctttctgcatttgtggatatacctattctggatatttcatatacatggaattatacaccttttatgtcttcttacacttataatacttttgaggttcatccccattgtagcatatattagtttcttatggctaagtaatagttaattgtatgtatgtattataccacaatgtatttatccagtcttccatttatggacatttgagctctttccatcttttggctattgtgaatagagctaccaggatcattcatgtacaagtatttgtttgagtactttttaaaaaatttctctgggatatatgcttaggtcatatagtaagatcaaaaatatttcctgatcttattccctttgttaatggaaatagtctcttcatacatctatggtttcttcaagactgtttctccaaggcagggagctagcttcttccttgaataactttgtcttcagctagataggaggagctcaaaagcaaaatgatagttcctagtggtatatatgctagaccaaaagaggagaaattcagtcactgagggttgccacagaatggtaacaatgagattaataataatggtttgcaggaaagacaccatcttgaaaggatgctgtgaggaattcattagataacacctgatagaaatacacaagatgcactttcctctatctccctttccattcttctgtctgcataaatgactgccctgaattcctttgtagagctatgatttaattattcagagtttggtatccacctaatctgtaaaccctactcgagatatttattttcagcacctgggacagagcccagcatatgacagtcactcaggaagcaattgttgaaagaatgaacaaatgttcatctgcttatgttcattgccagacaaaagaatctgcattttacatcatgtctattgtttactggggaggggcctatgtgacattgcctgtgtgaatttgggaaatgctaagacattttatttttggtgtttaatcttatactcccacatgggccacaggactggtccatcttatggaatatgaaaaaaaatgttcacatttcaggttgttcataaatctgcctcctgcattaccatttcttatctgcctacttctgcttcccctgagttcagaggaagtgctttaccttagaaatgattcactactcctgggccatcgtgggctttgaaagccacacaatagaagttccatttcaaatccccccatttataatcatgggagaaagctgggtgttgtcttgggggttatcaatgatttcagaaaactcaacctttgttcctcatgtgtccatttttcaaaaacttacgactccaaatctctggaagtcattgcatctgaggaaacatttatcttgggtttgacatcttttgcactgtatcccttttcaactctcctttctcatgtaggacaaacggcactgtggggtttgaaatgaagagttatgtcttgcagcaagtgcgtgtgtggagatcctgggctcctccctgccccctcccctgtgcccctgggttggaagatgaaggaataatcagcagagacaaatgcttatgagtgaggttatgggttgaattatatctacccaaatttgtatgtggaaattctatcccccagtacctcagaatgtgaccttctttgaaaataggtttcttggggatataattagtgaagatgaggttgtactggagtaggctggggccctaattcaatatgattgttgtcttcattaaaagagggaatttggagacagacgcacacaaaagaactccacatggagattaaggcagaggtctagaagccaagaaatgccccaaattgccaacaaaccaccaaagctatgagagaggcacgggacggattctttctcacagcccacagaaggaaactatccggccgggcgctgtggctcgcgcctgtaatctcagcactttgcgaggccaaggcgggcggatcacctgaggtcagctcaagaccagcctggccaacatggtgaaaccatgtctctactaaaaatacaaaattagccgggcatggtggcacgcacctgtaatcccagctacttgggaggctgaggcaggagaatcgcttgaacctgggaggtggaggttgcagtgagatcacaccattgcactccagcctgggtgacagaatgagactccgtctcaaaaaaaaaaaaaaaaaaaaaaaaaaaggaacctaccctgccagtactttgatctcagactcctagcctctagaactgtgaaacaatacatttctgttgttcaagtcacctaatttgtggtctttgtttttatagaagtcctaggaaactaatataggtgatactctcacgatgtttgtctaaaggtctctatttacttgagaggtgatatagcatagtggttaaatacttgggtttttagaaccagacacccaggcggataatctgggaaaattactcatcatctctaggcttccaatttccttaaaataagatagagaatataataaatctagacctgatagtactgtcatgacgattaaatgagataatgtatttaaagcactaagccaaagaaatacctggcacatagtaaacacgtgatgggtggtggttattataatggttattattagtaatgaatggcaacatttactgttgccctaaagccccaaagaatcctttactatctatattttaaactttcttcccagagcacacttaagaaatgattgacattttcccttccctctgacccctgctctctaggttaatggtctgaggctctgttccatctttgtccctttccagagatttaatctctctctctctctccctctctctctctctctctctctgtgacatgggacttatatgattgacacacaggaccacccacttatcatttacactagtggaagtaagatggttccaaaagctgggtgaggatttgaagtgaccagaatagttgccaggatcatgtattctttcatatacaaaaaacacatttgttgaaagccagtggtctaggtgtaggatctgatttagtgtgggttatttgtcaatgtgggcaggggaagggatgcagcataataattccataataactaccacttactgaaatgtatgtcaagtgccaggctaaattgtctcagcacaattatcctttaaaattctacaaggttagatagtcctgtcatacccattttatagatgaggaaatggaagcatggagcgattaaggccatagctggttaaagagcagaatcagaagttgaacacattccacagactctagagctcacacttttaactcctgtgagtcactgcctcagcggcaccaggaatccgctgctctcaggtgtatatttgaaaaagattgtgaacaagacagaggaaacctggttacagaattaaatgccagcatgtaaagcaaacatacaatcaaaaccaagctaatgaaaaaacaaaacaaaaccgaatccccaaaacccagaatacaaaaacctgccatgtgttggttactggaggaaaataagtgttttcctaatgtttaaactcagcaactgaccctaagacttgttttaattttgcgattgttttgaagctgctagtctgccaggcatatggtgcaggtaagctttgccaagtcgttcctccgaagcattttattacgataataatcacaaatgtgacctcagtccttttatcctgtttattctctaccgtttcctgtgataagtgctacttctgtactttgccaacctcctccacccgcatttgtttagggaaagaatattaattagtgatattaaggaggctatgggctgaaaatgaaattttcataatggaattccttagactatctttgccctccgaggcatcctctgtttaagcagttcaattgaatatcattattaacatacataataataataattagcattattgcctgcatcagttgttgttcatggaaaactgcaagctcttttctatctattggcctcagttaaaagtgcgaaatagattctcattttatgttttatttccctgtcatttttgctctgctcaactcctatgcttggcagctggaccccttatgaggtccttattggattttttttttttttggaaaaataaagaagtttctttattctcctgtttgaaagaggagtctgtcagaggtggaaaaccttcaataggccaacttttttaatttttaatttttaaagtttttttagaggcagcgtcttgctctgacatccaggctggagtgcattggtactatcatggctcactgctgcctcagacttctgggttcaagcgagcctcctgccttaggccaactttcctgagttgtcttgaagctttatttgtgcaccgtaagccactcaagattttctgcaaaacctctcctggtttctagcatctctctctcccaatccattatctggatacactgagaatcatgtttctaaaaagcaagtctggctttccacctcctttgctgaaaaaccttgataggcttcccattgcgctcaggataaaatccagatttcttatcatgtcttaatgccatgacccttatttcctcatctggctttatctctcctcactccatctccttctgcagtctgatcgtattaaacttgttttggttttgcagagagactgtgccacctcacctcaagctatagcatgtgctgtaaatgaaatgccctctcctccctgattcaggcttcagtgtgggcaccgagtcctaggagctttcctatcttctcaggtccaagggtggtgcctaatgttaatttcagggaggtataagactgcatacgatacgcgcttcttccccaagcactggtaaatgaatggctttgaatattttacatataggtcatagtatgcttctgtttctccccttcttggctgtttggcttagaatagggggcaacaaactttggtctgtgtgccaaaagcaatcagccacctgtttttttaaaacattttttaaaattgagagaaaattcacacaacgtaaagttaaccatttaaaaacatacaattcagtggcatttaggacattcacttttttttttttgagacaattcgactctgtcgcccagattggaatgcagtaatgtgatctcggctcactacagcctcgacatcctgggctcaagcgatcctcccaccttagcctcctgagtagctgggcctataggcatgtgtcaccactcccaactaatttttgtattattaatttatattttattttattttattttattttgaacaaaggtggattgtctccaccttttagtagagtattttgtagagtcagggttttaccatgtggcccaggctggtcttgaactcctgggctcaagcaatccacctgcttcggcctcccaaaatgctgggattgtaggtgtgcgccaccatgcctggccacatttccaatattctgtaaccatcacatctgcttagttccagaacattttcatcactccaaaaagaaagcccataactgttgagcaggtgttctcaattttcttctcctcagtcctcggcaaccaccaagctaccttctgtgtctgtggatttgcctattctggacaatttatatcaatggagagtcatgcattgcatggtcttttattcatttatttattttttgagacggagtctcgctccgtcgcccaggctggagtgcagtggtgcgatctcggctcactgcaacctctgcctcctgggttaagtgattctcctgccttagcctccccagtagtggggattacaggcatgcgccaccacacctagctaatttttgtatttttagtagaggcagggttttgccatgttggtcaggctggtcttgaactcctgacctcaggtgatccacccgactcaacctcccaaagggctgggatcacaggcgtgagccaccatgcccggcctacgttgccttttgtgtctgcttctttcatttagcatattgttctccaggtttatccacctggcagtatgcgtccatacttcctattcatggctgattactattccattggatgcatatgccacattttgtgcatccatttttcagttgattgatctttggattgtctgcaccttttagctactataaatagggctgctgtgaacatttgtgtacaagtttttgtttgaactcctatttgtaattattttcggcccatgcctaagaggggagttgccgggtcatatggcaattctgtgtttaacccttttaggagccaccaaacccagtgcctgttgttgtaaataaagttttattggcacacggtcaaggccattcatttacttctcgtctatgactgcttctgtgcgacaacggcagagtcaagtagttgcaacatacgccatctgcccctaaagcctcaaagattaatttttatggagttttacagaagtttgctgaactttaacttagtacacctgtgttaagcaatgtagcctgcaggccttgaagccagtaacagcactttttcaacaaagatggggtgaatacagaaaaaaaagtttattctccttaacctgacttatacattcctgatactttagaatattttatgtagatctgaggagcctattttgaatatcaaagggtgaggtcaagtcttgtgggaaaagtggtctggaaaattgcctagactctggagtcagactttgtaggttaagtcacgaaacctctctgggcctctgttttctcatcctttaaatggagatgattaggctccccatcttgtaggacggtagagaggattaaatgaaggaaacactggcgaactgcttataatggtgcctggcataaatattaactcttactaggtgaggctcagagatcgcccaggacaaagaaagaaaatggatcaatgagctagtttatctcatgcctttggataaaatactctacacccctcctcttaaaattgtttttgtactgcgatttttatttttgaggtaggatctcactctgtcgcccaggctggagtgcagaggtacttggctcactgccacctctgcctcccatgctccagcaatcctctcacttcaaactcctgagtagctgagagtagcatacatttagcgaattgttttatttttctgtagagacaggtctcactgtgttgcctgggctgggtagcatgattaaaaaaatttttttttgagacagagtctctcgctgtgttgtcccggttggagtgcagtggtacaatctcagctcactgtaacctctgcctcctaggttcaagcaattctcgtgcttcatcctcctgaatagctgggactacaggtgtgcaccaccacatctgactagctttttaaaagatttttagtagagatggggttttgttatgttggtcaggctggtcttgaactcctggccttaaatgacccatctgtcttgacctcccaaacctcccaaagtgctgggattacaggcatgagccactgtgtccagcctgggatagtgtgatttttttttttaatcgtgataaaaatatagggtaatataaaacttaccattttaacctttttttttttttttttttttgagatggagtctcactctgttgccaggctggagtgcagtggtgccatcttgactcactgcaaactccacctcccggtttcaagcgattctcctgcctcagcctcctgagtagcttggattacaggcatgcgccaccatgcccagctaatttttgtatttttagtagagacggggtttcagcatgttggccaggatggtcacaatctcctgacctcatgatccgtccacctcggcctcccaaagtgctggcattacaggcgtgagccactgcgccaggcccattttaaccattttgaagtgtacaattttaagtgtacaattaagtggcattaagtacattcacattgttgggcaaccatcaccaccatccatcttcagacgcttctcatcatctcaaactgaaactctgtccttattaaacaccaattccctatgcctccatttccccatccctgggcaaccactgttctattctctttctctatgaattcagctgctctagatacctcatataagtggaatcatatgatatttgtctttttgtaactggcttatttcactcagcataatatctttaagtttcatccatgttgtaacatgtttcagaatttcttccttttttaaaacacatttttattgtggtaaaacacaaataatataatatttaccattggaaccacttttaagcgtacagttcagtggtattaagtgcattcatattgttgggcaaccatcaccaccatccatctccagaatatttttgtcttagaaaaatgaaatgcaggctgggcatggcggctcatgcctataatctcagcattttgggaggccgaggtgggcagatcacctgagattggaagtttgagaccagcctgaccaacatggagaaaccctgtctctattaaaaataaaaaattagccggctgtggtggcgcatgcctgtaatcccagctactcaggaggctgaggcaggagaatcacttgaactcgggaggtggaggttgtggtgagccgagattgtaccacagcatgggcaacaagagtgaaactccatctcaaaaataataataataataaaatcaaataaaataaaatgcagctgggcacagtggctcatgcctttaatccttgcactttgggaggctgaggcaggaggatcacttgagaccaggaatttgagatcagcctgagcagcatgttgagaatctgtttccaccaagaaaaaaaaaaaaaaattagccaggtgtggtggcacgtgcctgggaacacagagatgaatgcagttggagtggagcaagacaggagaatggtctgagatggtgaagagacacgtgaggccaggctgtgctgacctggtgagatcctgggagaagagtttgcacttcattcctagtgcgatcagaagccaggggagggttggccacaggagagtgacatgatcatcttcactgattgctgttgaaaaagacggttctactctttgaccactggctttgtaaagaggttttcaaggctcagagatggcttgtattgttatattaggagaggtttgatggtagccgacctggtagtggatgttctgtttcaggtgccataaatggggccatacatcaaacccattgattttctacttcagagaccccaagagccatacaaccctaaccctcagtgcccctgcgtaaagttagacagacatcgtttattggggttacagagcagctgtctaaatcctgcctggactcatttaaagcagtgtgcctcgggggcaccttgctcctgcaaacatttcagagccaggaaagactgactggggatgaaggatgcacctgacttcttggcacctgctgctgcatttttgttttgattgtttgcatgatgcttggaggagaagcagggaaaaaagaggccgataggcgtttttctctcacttattgttcttttttctggccttggaaggatggaaggaaggaaggaaggagggaaggaaggaagctaatatctattgaacagcaatgcagggactggatagttatggtcccaagttacctaatttcattcattcattcattcattcattcattccacaagaaatattcattgagtgtctttatatgccagacattgttctgggccccaggaataagcattgaacacaatggacaaagcctcttctctcttggggctgactttctgacaaggaagacaagacagacattaaacaggtaagtacaaatcaggcggatatgtcctaggaggaaaaaccaagctgagtaatgagatggagagagtgtggactattttatgtgggagggggacactggtcagggaagctctctttgcaaaagtggtatctgagcagagaactaaagaaaataagggagagaagcaccagactttctgtggatctaggacattgttatttcttcttagagaagagtctactgagaattggaggaattaagtgactcttccaagatcagaagatagtggtagcagtagcagcagcagtagtagtaatagataaattttattacatttgctctatgccaggcactagatgaaatatttatttctatcatctcatttaattttcacaacaaatctacaaggtagatatcattattgttattcccattatataaatgccaccgaggatcatagaagtgatatcacttagctaaggtcacacagctaataaaggagaagcagagattcaaatccacgttcattagtctccaggacactataaccattttccagcccatagctgatgaagctgaaatacagagtgaagcctctatctgaaaacccttcttttccaatagaccagtccaaatcccaactttcaatgcagtacccggttctttgattagaccctggcatagggtttgttaggtgggtattgagggcctcctaaataatggagtagtgcatttggatctgtgaccacagacattttgagtcccaccatctctgatttgcacagagaccttcttgtgaccaattattgtgagtcaagagctcaggtgtccaatgaaagttcgcagggagctactcttctcttgaaagaaatgggctatagagctctattggcctgggatgtgcagctccattggtccatgatttgatgagaaagactgcaaacgtgtgatccagatatatggatgtgtatatgcctcttagcaagaatgcagttgattttctaggtctatggagctatgcacacagctatagcattcatttactcactcattctgtgctgtgcctgctagtgtgttacattctgagtctgcagcaatgaacaggcaaggtccctgtcttcctgttgaatacattataaggggagaatgagggagtgttgtgtgaagaaggagaaaataaagcggatgaataaatgaacaagatcatctcagatgctgagagtgccctgaggcattgccacagagagacactgggatgtctgcttatattgagtggtcagtggaggcccctctgagcagggccaattgaacagaaggggagggaggagctgccatgagcagttctgcagaaaagcatttcaggtgccagaaacatcccggtaacagacagaagactgggtcaaggggtacgtgccttaaggactgtgataattaggtgggtacacaaagtattttgctgagacttgcaaaaaggaaaccagagggaatgccagcatgaaaaacatgagatttcaagtctgtaactgctaaaagtcacagactctttataacttatgagctctttataacttatgggccgcaggagaacctttgaagaatgtggttcaagagaaggattagctagcagagaagattttaagaaatatgtcttaaaaataattttatgatgggaaattccaaaggtatatgaaagtagaagaatagcacaatgaattctcaggactcactacctggcttcaacaatggacaactcatgcccagttttgcttatacctctacctgttttccccacatacattattttgaagccaattccagtcactaccatttcatctgtaaatattacaatgtgtatcttgaaaagataaactcttaaaaacataggcacaataccatcagtgcacccaaaacattaacaatgattccttagaacatcaactatccagtcaccgttcaggttacttactgcctaatacaattttttctttcttttttatttttattttactttaagttcttgggtacatgtgcagaatgtgcgggtttgttacgtaggtatgcaagtgtcgtggtggtttgctgcacctatcaacccgtcatctaggttttaagcccagcatgcattagatatttgtcctaatgctctccctccccttgacccccaccccccaacaggccccggtatgtgatgttcccctccctgcgtccatgtgttttcattgttcaactcccacttatgagtgagaatatgtggtgtttggttttctgttcctgtgttagtttgctgagaatgatggtttccagcttcatccatgtccctgcaaaggacacgaactcattcttttttatgtctgcatagtatttcatagtgtatatgtgccacattttctttaactagtctatcattgatgggcatttaggttggttccaagtctttgctattgtaaatagtgctgcagtaagctctctcacccaggctgaagtgcagtggcacaatctcggctcactgcaacctctttcccctgggttcaagtcattctcgtgcctcagcctccccagtagctgggattacaggtgcatgccgccacacctggctagtctagtttttgtatttttagtaaagacaaggttttgccatatggtcaggatggtcttgaactcttggcctcaagtgatctgccgcccgccttggcctcccaaagtgctgggattacaggcataagccaccactcccggctctgcctaatacattttaataataatttctttgaatcagaatccaactaaagtcctacacatagtgattggctcatgtgtcttttaatctataggtttccccttcagttcttttattgctggaaaaataggttattcatcttgtgtaattcaaaatgtggtcagtgaaccaggatcatcagcatcacctgggaactcggtagaaatgcagcatctcagatcccatcccagacctcctgggttagaaactacattttcacaaggtccctgggtgttttgtatgcacaattaagtttgagaagcactgctgtagagtcccccgcagtctagacattgccagttgcatctctgtggtgtcctttagtgcattccttcatcttccacttttctttcttttctttctttctttttctttctttctttctttttctcttccttcctttctgtctttctttctttcattcctccctccctccctcccttccttccttccctccttccttctttcttttccttccttccttccttccctccctccctcccctaccctccctccctccctccctccctcccttccttccttccttccttccttccttccttccttccttccttccttccttccttttttcctctctctttctttcttttttgtttgagttggagtctcactctgtcacccatgctggagtgcaatggtgtgatcttcggctcactgcaaccgctgcctcccgggttcaagcaattctcctgcctcagcctcccaagtagctgggattacaggcacccaccaccacgccccgctaatttttgtatttttagtagagacggggtttcaccttattggccaggctggtctcttagccaagctggtttcaaactcctgaccttgtgatccacccacctcagcctcccgaagtgctgggattacaggtgggagccaccgtgcctggcccattgtccacatttctgtaagttgataagttgtatctatacatttttatcagatttaggtctgattttttcttttttttttttttttttttttagcaagaccactttttagattgttatgtttttccatgaggaggtaactgatgtctggttatctcccattgtgtttttattttttaaaattatttttattatttatttatttaatttttgagatggtgtcttgctcagttgcccaggctggagtgcagtggcatgatcatggctcactgcagctttgaccttgcaggctcaagtagtcatcttacctcagcctcctgagtagctggcaccacaggcatgcactaacatacccggttagttttttacaaaactaatttgtagtgatggggtctcactgtgttgcctaggctggtctggaactcctgggctcaagtgatcctcccactttggcctcctaatttgctgggactacaggcatgagctaccatgcccagcctcatttgtgatgttatctatctgctgtatgataatgcctagatccatgaattcattaagggttgcaaaacagagcaaggctttgacttgagtggatccagtttattttggaagtgattaattctctaatttttattcaccatttctataaaattaatggtatattgcaccaattatgtgccaggaactgttctaagggctttacataaatgaatgcatttattgatcctcacaaaaatctttaaaactgtgtattcatttcctattgctgctgtaacaaattgccacaaacttagtggcttggaacaatccaaattattatcttacagtgttggaggtcagaagtcccaaagaggtctcacttggttaatatcaaggcattgacagggctgcattatttctggaggctctggggagaacctttgcctcttccaaattctagagaccacctgcagtccttggcttgtggcctctttctccatattcagagctactagcataacatctttaaatctctctctgattctcttcttcctccctcttccacacttaaggacccttttgattacatcggttctacctgcacaacctcctggttttaaggtcaacattgattccatctgcaactttgattcccttttgctgtagaatctaacatattcataggttccaggaattaggacacagacatctctgaagggacattattctgccagccaccactaggctctttggttcctgttttacagacaaggaaactgagatacatcgaggggaaataactcatccaaattcacacaggtcctaactggtggagcttggatacaaacagagagagtctggctccagagtccatgctttgaacccagcagatgtgagatcacttagtgctcaacactgaatttcctctgagacctcgatcttgccaatgaacatatgtttttaggaacattgaatcctgcggttgtcaggggatttctgcacacaaatgttagccggtgaattcaccgttctttccgatggtaagttagtgtttccctcctaaaaggtggtaacagtgggcttgtccttggttcagtctgtttcttcttaggcccagtcagttacccactgaattaaccccacgctggaccctgacctctttttggtaccatgtacccttttggcatctggcggagtctatgacctccttctgagaacaatatccttttttttttttttttttttttggagaagatatgtttattaatggatgattacattagctttctgggcaacaaacctaaatatgcctactaatattgatcttctattcaactcaaactgaataacataacttgttctcaatataacttactttttttaaagtattattgcatgcccttattttatttaaactgagatcttcttggtgtcagacgtttatctcaacctataggtaaatatgtttacaattataaatctgctagtaaacatattatataacttcttctacttagtaatcttcatattagacaactatagcttaagtatcatcatactagttatactcaaattttccctattgccttaaagattccctttggcagtttgtttgtttaaattaaggcccaaaattcacatatttccttttttatatatataaatctttctaactccaaaacaatatttaaccattagcactttttatttttggtccattcagttttgggaaaatgttatttaggctatgaaatattctatactagatttgattgattgttctttgtaatattgtttaaattatttatctatgcaaaaaataaagtgcatggaattacaaaggaaaccaattatactaaaatatggttatcaaaatataaaaaaactcaccaaatttgtgtcatagtaatatgtgaatctttactaatgcatcaaataacaagatttagtggtgagtctaataactatgtaattccaattagtgatgcacacgtacaatataatgagatgtctgctatgattgtaatgagatatgaaaatatcgtgatttatatcggtgacaaaaatcacagatattgcaaatactactgtggtttgttgcttccatttataatagaaggaaatgctaaattttagttagcaatcagagaaaatgaggcaggtttatggaccctctgaattctacccacaaacctcaagttgggagccctggcctagtaccccattggtttgtgctgcttatttagtatttctctctctctctctctctcttttttttttttttttttggagacaaagtctcactctgtcacccaggctgaagtgcagtggcacgatcagagctggctgcaacctctgcttcccgggctcaagcaatcctcccacctcagcccactaagtggcagggactacaggcatgagtcaccacgcccaactaatttttgtaattttttgtagagatggggtttcaccatgttgcccaggctagtctcaaactcctgagctcaagcagtccacccgcctcagcctctcaaagtgctaggattccaggtgtgagccactgcaccgggcctgtttcgtgtttctcttaatttgatagactctagcaaatacctgttgagaccccactgtgggcaaggcatgtgctagggacttgggagagagcactgaacacacagagctggccttcaaggaacagatagatttcttttaagattttcccgccttccttctggggggagagtgtcttcacccttcagtgtaattgcaaactccttgaaggctgggagtggttctaagtcccttctcttgtcaggcctcagatgataggcattgaagaaacaggaggttcaaagatcaatgtttacacaaaacgattttcggtcgttcatggaaaaaaacattttattatttaacagttaaacatttatgttaatgcagataagaaaatatatagaactcagctgggtgtgatggctcacacctgtaatcttagcactttgggaggccgaggtgggagaattgcttgagtccaggtgttccggaccagcctgggcaatatagcaagaccctatctcttaaaaaaataaaagaaaacatatagaactagccatcttaatacataatatgggttattattgcctaggatgaggacttttcttctttttataactgtgctgaaaaggacatgacattgtacttaccatcttcaccattttataatgtacagttcagttgtgttaagtgtattcacgttgtgcaatagatctgtagaagtatttcatcttgcaaaacggaaactctagacccattaaacactaaatacctccagcccttggcaaccgtgattctactttctgtttctaggagtttgactacttgagatacctcattggagtggaattgttcggtatttgtccttttgtgactggcttatcacataaagtcgtcgaggtttgtctatggtgcagcaccccacaagatttccctctctctctcttttttttttttttttttttaaagacagggtctcacgctgtcacccaggctggagtgcagtggcatcatctcggttcactgcaacttctgctccctcgactcaagtgatactcccacctcagcctcctgagtagctggtactataggcacacaccaccatgcctggctttttttttttttttggcatttggcagtttgtttgtacattgaaatacaagatctctgaagcttttgtagctataaatgtttctaaatgatgcaacacatggtctcgccatgttgcccaggctggtctcaaactcctgagctccagcaattggcccgcctcagcctcccaaagtgctgggattacaggcgtgagccactgtgcctggccaaatatccctctttttaaaggctgaataacattccatcgtacgtagatatcagattttcgttatcccttcatttgccaatgggcatttgggttgctttcacctcttgattattgtgaataaccctgcaatgaacatgggtgtgcaaatatttctttgaaatcctgctttcaaatttttgggatatatacccagaaatggaatttctggatcatatggtatttctatttttaactttttgaggagtttccataccgttttcctgtagcaactgcaccattttcattcccaccaactgtgcacaaaagttccaattcttcacgtcctcgccaacacttgttattttctgtttttttttttaattgtggccatcataatgggtgtgaggtgatatgagatgaggatatttcaagataatattaagtaaataatagtagaggtgttcaatagaaatggcaaaaatgaagatgtaccaatgcatgaagtttggaaacctcttttttttttttttttggacagtctctgtcactcaggctggagtgcagtggcacgatcttggctcactgcaacctctgcctcccaggttcaagcgattctccagcctcccaagtagctgggattacggacacctgccaccatgtccagctaatttttgcatttttagtagagatgtggtttcacattgttggccaggctggtctcgaactcctgacctcaagtgatctgcccgcctcggcctcccaaaagtgatgggattagaggtgtgagctatcatgcccaacctggaaaactcttgatcagacaacttctaaagctgcccaaagtgtggtctgtggtcagtaatggcctgagaactgttccttgtctgagaccagataagacagaacttgagggtacctgtttagaaggatagcaatttaacattcctaaaacatctgaatgcatgatcgttattctagtaatttgcttttattgtattttatgaacgtattggcccacgatggattggcaaacaaaagaagacaaagcaaagctggccctgcagccctgacagtctgagaagctctacagttccgcccaggcttggcaacataactactgaacttattttggcctcagattttccatctataaaatgaggataagaaaaggaaagctcagtcttcattttattttatttttgagacagagtctggctctgttgctcagggtggatcatgcagtggcgcgatcttggctcactaccacctccacctcctgggttcaagcgattctcgtgcctcagcctcctgagtagctgggattacagtcttgtgccaccatgcccggctaatttttgcacttttagtagagatgtggtttcaccatgttggccaggctggtcttgaactcctgacctcaagtgatccgcccacctggagctcccaaagtgctgggattacaggcgtgagccactgtgcccggccgggagcccagtcttgatcgttgtcagctagtagctggcctggtactactgctaggctgtggtgttccctacttaagcaatttcataggatggtcacactggaagatgtcatgctgaccatgatgaaacaagacaaaaacaagacagtctgtaatgaatcctatctgagcatgaaagtatgagcagtgggcaaaccacaaaaaaatggccaaacgcatcctctccttctgactgacacatgcagttactgctggttttccaatgacagctttagccccactctattcctcctgcctcctacataaaaattatgatgatgcccagccatggaattaacactgctttctgccagctaaccagaagcgccccaacacactcttactgggacacagctcccactccccatggtgtgtggtcttccttgttgcaacaggttactaaacccatttctgttcaactacaggtgtgtttctggtggcttctggctgatgagcatgacaggaataataatagatggctataggtttaaatgagttcatgcatgcaatatgcttagaatgatgcctggctccaagtaaggtctattaaaatgttagatattattattattgttattattattcggaatagcgtcttgctgtgttgcccaggctggagtgcagtggtgtgatcatggctcactgtagcctcaacctcctggggtcaagcaatcctcccactttagcctcctgagtaggtgggagtacaggtgtgaggcaccattacaggcctattattattaataatattatctttgtccctcacagtgatgggcaccacatcttgccatagaaagaccccatacttgctgggcacattggctcatgcctgtaattccagcgtgtttagaggcctaggcgggagtattacttgagcccaggaggttgagaccaacctgggcaacacaatgagatctagtctctacaaaaattaaaaaatcagccagctgcggtggtgcaaatctgtggtcccagctactggggagggtgaggtgggaagattgcttgagcccaggaagttgaggtttcagtgagctgtaactgtgccactacactccagtctgtgtgacagagcgagaccctgtctcaaaaaattgaaagacacaccccacacttgtggggacaccaaatttgtggattgatttgggatagtgtattcatcatctattgttgtgtaaaaagttaccccaaatgcagtagctgaaaacaataaatacctattatctcacagcttctacgggtcaggaacccaggagcagcttagctgggtggttctgactcaggatctctcatgaggctgcaagtcaggctgttggctagagctgctgtcacactgggactcaaccagaggagactctgctccgaagttccttcacatgggggctgtgcctccccatgcgaacctcgccattgatggcctgaatgtctctgcaacatggcagctggttcccgagagagagagagagagagagagagagagagagggagagagcaagcacaaccctattctattcatgatgcagactagccctggtctgtgcatggtgggggatgccacacaaggggatgaatacctggaggcaagaataattgggaccatcttgcaggttgggccatagagggcctccctgttcctccaagtgccctccaacttttccctcttggcttcaacttttttttttgtttgtttgtttgtttttgagacagagtctcactctgtcacccaggctgcagtgcagtggtgtgatctcggctcactgcaacttccacctcccgagatcaagggattctcctgcctcagcctcccgagtagctgggactacaggcgcccgccacaccatgttgggctaattttttgtatttttaatagagatggggtttcaccgtgttagccaggatggtctcgatctcctgaccttgtgatctgcccacctcagcctcccaaagttttgagattacaggcatgagccaccgcacccagccgggcttcaactttaatttagaccaagaagacatctccattctctctgaatggagcttgaagacaaacaaacaagaaatgagtgtgagtatagctggggtgggatggggcctacaggtattggagaggcagaaatctcgtcctgtctgttgacatttgtcaaggcctctgcagggacaggctcctgggagactctgcagtcagctgcacttccagagggagaagaggcatacgctttctctctctctctctcctcttttcttcctctctccctcctccctgcagcaagagtcttgaatccctctgactgacagtgtcagattgtcttatcaaaacacgggtccgggactacactgtgattggctgtgcagaaccattgtggggctggagaattcttctccgagggaaatgattataaggcattttaagaacagcaagctgaatgctacgcacagctggcagttcttgtttttgacaagtaataattgcctcaggtgcaatggaaagtgggggtggggggctctgtgagtttattttgagaggaggctcagtgcacaggggttgggcattggacaaggaggggtgagtgggagcaacttggctcagggggtctcagactgactcgatctgaggctgagggagcatctggggtggccctgagtgacagtatgtttccttctgtgcccctgggaacacctcttgccatctgagtggggagacagggggtgacttgtgattgtaggaaggcccagatgttctgagcaaactgacccaaagcagcatctgtcctgcatgggggcctggccctgtgagggtgatgcacgagcggcttttgtgcttagagagccctggaaccactgtatgccttgctagacacttgctactcaaagtgtagtgcctgggccagcagcatcagcaccagcctgggagctcataagaaaagcagaggctcaggtccccctcagggacctacagaatccaaatctgcattttgatttttgtttttgtcttttgttttgaatttttttttttttgaggcagggtttcactctgtcatccaggctggaattctggggtgcaatcatggcgcactgcaacctcgaactcctgggctcaagcaatcctcccacgtcagcctcccgagctgacatgcctagctaattttttttttttgagacgaagtttcactcttgttggccgggctggagtgcaatggcatgatcttggctcactgcaacctctgcctcccaggttcaagctattctcatgcctcagcctccagagtagctgggattacaggcctgtgccactgtgcccggcgaattgttgtatttttagtagagagggggtttcaccatgttggccaggctggtctcgaactcctacctcacgtgatccactcgcctctgcctcccaaagtgttgggattacaggcatgagccactgcacccattatatatttttttaagcttcaaaaaagaaaatgggcactgccatggaaaggagaagctggattgtatgccaggcagtcaaaaagccaactgtttttgatgattggagtgctggttacagagggagctcattttcttttttaaaaatatatttaaaaatgttttataaggccgagatgggcagatcacctgaggtcaggagttttagaccattctggccaacatagtgaaaccctgtctctgccaaaaatacaaaaattagctgggcgtggtggcaggtgcctgtaatcccagctactcgggaggctgagccaggagaatcgctggaacccgggaggcagaggttgcagtgagccgaggtcgtaccactgcactccagcctgggcaacagagtgagactgtctcaaaaaaaaaaaaaattatagatttagggggtacaagcgaagatttcttacatgcctattctgggattttagggtaaacatcacccgaatagtgaacattgtatccaataggtaatttttcacttctcattcccctcccgctctcctaccttttggagtctccagtgtctagtctattattccgctctatatgtccatgtgtaccctttgtttggggctcattttcttttctttttaaataaccttcatttaaaaaaagttaatatgtgcattatcggaaactgaaaaacacaagaagcaaagaacaaaatcatctacaatcacaagcagtggaactcatctttttttttgtttttttttttttgttttttttttttgagatggagtctcactctgttgcccaggctggagtgcagtggtgtgatcttggctcactgcaacctctgcctccctggttcatgccattctcctggctcagcctcccgagtagctgggattacaagtgcccaccactatgcccaactaatttttgtatttttagtagacactgggtttcaccatgttggccaggctggtctcaaactcctgacctcaagtgatccgcctgcctcggccttccaaagtgccagattacaggcgcaagccaccgtgcctggcccagaacacattctctttatgtgattttgtgtcaatgtggagagatattcaacaaggacatggagtctgtcagactttgcattgccccatttcctgtatactagtttgatgcttgctctatgcagatgtcttggctcatgaaggcccatgtacattctggaagacggtcatggagccagggaccaagtcctgtggctgagaggataaaggactctgtcccagtctggaactgatcacctcagagtaacatgatggggtagtccatggactttcacgtcagaccaagctgggtgtaaagccaggagctgccactcagcagctgtgtcacctcagggaggatgctgtgccctccccttcccccagagaatggcctctgcccggcctgccttggtgagcacaggagctcatggattaagatgtgtaacatgctcagcatggggcttggcacattacagtcagtgctgaataaaggctaggcattaatatgatgttgataaattgttttattttatatgatttaaagataagctttgaggtgatgccgggggagagcgtggatgggaaatttgatagtttcaggagtttgaagaaggcacttctagaagagattggtgatgaaaacagcaaggtctacagagctcttatggaggtttctttttctttctttcttctttttttttaactgagatggagtctcgctgtgtcgcccaggctggagtgcagtggcgtgatctcggctcactgcaacctttgccacccaggttcaagcgattctcgtgccactgcctcccaagtagctgggactacaggcgcacgccatcatgccggctaatttttttgtatttttagtagagacggggtttcgccatgttggccaggctagtctcgagctcctgacctcatgtgatccacctgcctcagcctcctaaagtgctgggattacaggcgtgagccaccatgccccacctccttatgaggtttctatgtggttcttcactgagttccaggacactcttccctggccagcagtaaatcaggaagacagcagtccttagagctgaggtggtaacacaggatgtttgcaaaagggttgaatatttcaggagaaaatagctaatcttgtctttaaaaaaatcagccaattaaccaacaaaccatgtgacctcagataaatattgtttcctatccagctcaatttcctcatctctaaaatgagagagtgtatcctttattccctccatgccaggaactaactgagaagtagagctagctatttgataatcatcaaactaagagctttcttctggtgcacctgcgctggagaacacccacataaaacgatagtaactgtgacgtgccgtgaagaaaatgtgctgtgacaaccagagcagatctgagtgggacagggagctcaagatataacatttaagctctgatctgaagaagtagctggaggtgagtgcattcagcatatgcaaagatcctgtggcaggctggaggaactgaaagaaagtcaatgtggctggagggagagcaggtgcaaaccctcctacatcaaaccttgtgagccctatgaaagattgcacatgttgtccaaagattgaagggttttaaacaggatgttaatattagcatattagcaggagctcactctggcagcagggtggagaggggatggatctctccttttttggaaaggatcacattgtaacccttctcttgccaaattctctttccctcatatgggctgcttttgtttgtgagatgaagagcaagaacagagtagtggtagatgagggctgctagcagctctaccagaatggcaggacatttgagagctgaatggagaatgggtgtaattaaaagaaaaaaggtggaaagacctggcttgatttctcttgccaggaatgattgtactacacattcccgctttaacaccgattttctgtgaaaggtatattagtccctaggctgagttctccgcccaggggcggtacaagaatgtgagaagcaaatactctctccaggagataaaattctaggggactttttatgttatgtctcaggtcccttgacatgaattggctttgtccagccgtcagacaaaaacccaatgcaactgttaatttgtggtggccttggatgatgggtgaaagtattagtctgtagcttaaaacctcaacagcgtgtccttcctcctccaaagtggtaattaaacacggtcagatgtgactcttgccaggctgtttagttgtgctgggcaaggtctctgaattagagatgatgactgtaaaatgtttgtgggttgaaagtcctctcttgggtatacagaaaagatatagagagagtagagaattgtgttctagttatgagtcattcatccaacaaatatttattgagcattgtcccggatacgattggtttcccacctggatcccacttaggagtctaaggcagctgccagggaattgtgctcagctgatggtgctgaggaatgcctgggaggttacattttgcaccctccccaggggcagccccctgccaatggagaggccatatgtaaagctggccccttgatacaggctggataattctgtgatggcttcatgccccagagctccttgtggagttggtctgagaataggctcctgctgaatctatatactttccttttctatctcacttccctcactccctttctcctgagggtgtcagaagtattcaaacgagagtgactccatcttaatatgagctgggtgaaatgaagctgagatttgctgggccgcattcccaggaagttaggtatccttagtcacaggaagaggttggaggtcagcaggacaagatacaagtcataaagaccctgccgatggccgggcgctgcggcttccacctgtaatcccagcactttgggaggctgaggtgggtgtatcacctgaggtcagcaggtcaagaccagctagttcaatactagcgtgaccaacatggtgaaaccccatctctactaaaaatacaaaaatcagctgggcgtggtggcgagcgcctgtaatcccagctctttgggaggctgaggcaagagaatcacttgaacgagggaggcggaggttgcagtgagcagagatcatgccactgcactccagcccgggcgacagagtgagactctgtctcaaaaataaataaataaaagaccctgctgataaaacgggattcaataaagaagccagtcaaaacccacccaaaccaacatggtgacgatagtgacctcttgttatccttgctgctaattatatgctaattataatgcattagcatgctaaaagacactcccactagtgccatgacagtttacaaatgccatggcaacgtccagaaattaccctatatgctctaagaggaagaggaaccctcagttccaggaattcctggcccctttcctagcaaactcatgaataatccatccctggtttagcatatgattaagaaataaccataaaaatagccaactagcagcccttggggctgctctgcccatggagcagccattcttttattccttttctttttaaataaacttgcttttactttactctgtggactcgccctgaattctttcttgcatgagatccaagaatgctctcttggggtctagattgggacccctttccggtaacaagaacactccctcaataaagcagggcataagtccctgtttcaggctttgctcctgcagaacctgcctaagacctgctgtgtgttgggcactgtgtctatgccttggagatagagtgttaaacccttcgagcaaagtctctgccccaaggcagctcagtgccttctagggggtctgattttccatatcctagtcttgtaatttgttttttcttttttctttttctgagacggagtcttgctctgccacccaggctggagtgcagtggcgtgatctcaactcactgcaacctctgcctcccgggttcaagcgattctcctgtctcagcctcccgagtagctgggactacagctgcatgccaccatgcccggctaattttttgtattttttttagcagagacggggtttcactgtgttagccaggatggtcttgatctcctgaccttgtgatccacctgccttggcctcctaaagtgctgggattacaagcatgagccaccacacccggcccctagtcttgtaattttgagaagtcgctggagctatgcgagcctcaaatttcttatcaatcgaatggtggtaacagtgcttgtctttacttttttccttctattttttagtcttgcactgtcacccaggctggagtgcactggcatgattccaccatactgcagccttgaactcctaggctcaagtgatcctctgacctcagcctctggagtagctgggactataggtacattctaccatacctggctaatttaagaaaaaaaaaatttttttttagacccaaggttttactattttgctcaggctgatctcgaactctggcctcagtggatcctcctgcctcggcctcttgaagtgttgggattacaaatgtaagccagggcacccaaccaatgctttccttttctgaaaagaccaagcaacagcagcagcaggatggtttaagccttcttaagcatctgtcagctgcccttccccatcaccacttccagatgacagccttgtcttctatttctagctaggttgctgctgctatacatggaaattctggatcctccattttaggaccatgaattgatagaaaactggctctcatgctgctacctaggtgtttgttgaatgaatgaatgttgaatatgattaacaacagtgctatcattcaagcagcccaggtactggaataagcactttattgcttcttttttaaaatttttttatagagaaggaaatggaggcattgaaataccaagacatactgaatatgagagcaattcaacaactatgtaaagcacatatacagatgtaaaatgttagaagacaggactttggatggaaggattaatttgcagcactgatgtttcctaagaaaatggtcagaagaaatttcttttggaatgttctttgttttttcttttttgttgtttgtttttgtttttttctgagacagagtttccctcttgtcacccaggccggagggcaatggtgcgatctcagctcactgcaacctccgcctcccgggttcaagtgattcccctgtctcagccctcctagtagctaggattacaggcacccaccaccatgtccagctaattttttgtatttttagtagaggcgggggtttcaccacgttggccaggctggtctcgaactcctgacctcgggtgatccacccgcctcagcctcccaaagtgctgggattacaggcgtgagccaccatgcccggcctggaatgtttttctataacttgttcctttttcagttcacatgtggacaacccttttaacccattgttcaaggtcatggagattgtttttgaaacttgaaaccaaacacttacagatggctcccccaaaggatagagaaaaggaaacgagaaacaagaaaatcacaaccacctgctattataaaaggagcccgcatgatgaagtttttagaattgtggatctgtacttctgctactgcttaggttttagtggaggcaaaataatgccaatagctaatttgtttggtcattaagctttgatagaacttcagtctaagggacatacaattatattaatgtacatgctccagagtccctggttttatgatctgtggattatttatcattgtttcaggatagcagtagtttactttggtttcatgatttttttaacattggttctggaatccaagagacttggtaggattctttgtttttgtctttccttaatattattatcatcatttttttctttttttttcttcatttgagacagtgtcccgctctgttgcccaggctggagtgcaagtggcataatcatagctcattgcaaccttgacctcccaggctcaagcgatcctcccacttcagcctcccaagtagccgggactacaggtgcatgccaccatgccttgctaatttttaaaattttttgtagacatggagatctccctatgttgcccaggttggtctcgaacttttgggcacaagagatcctccttccttggcctcccgaagtactggagctacaggcgagagccaacatgcctgacctgttatcatttttttattttatttttcttggctctgccatttactgtgtgaatttgggcgaattactcactttttaaaattttttctccccttcccttcccttcccttcccttcccttccctcccctcccctcccctccctttgtgcctccctgcctacctttcctctctctttcttttcaatagagatggggtctcactttgctgtccaggcttaccctgaactcctggactcaagtgattctccttcctcagcttcccaaatagctgggactacaggtgcatgccaccatgtctagctaatgtatttgtttttgattatggcataacaaagcacccaaaaacttagtagcttaaaacaacacgcagtttctaggggtcaggcatccaggtacagcttaactgggacctctactcagaggctctcacaggctgcaatcacggtgcccacaaggctgcagttatctcaagattcaacttggagaggctctgcttccaggctcatgtggtcattggcagaattcagttccttgagagttgttgggctgagggcctcctttcattgctggctgctggccagaagctgccctgtttcctgctagatggttctccctgacaacagggaagcttgttccatcaaagcaagcttgtgagaaaatatctctatctctgcctttatctatctatatgtctatatctacatagagaaagaagacagaactcacaggttttttttttttttttttttaacggttatggacagaattgcagccatctcccaatctcccaaatccacatgttgaagttctcactcccaatgtgcctgtatttggagacagggccctttcagagatacttaaaataagccaggttataagggtggggccctaatctgataggacctgtgtccttacaagaagaggaagaaacatgataggaaagaccatgtgagaacacagtgagaaggtggccgtctgcaaggcaggaagagagccctcaccagaaaccaaccctgctgtcctaccttgatcttggacttctaccctccagaactgtgagaaaataagtgcctgttgtttaatctcccagtctgtgatattttgttttggcagcctgagctgcctaatatgataacctgatcttggaagtgacatctcaccacttttgccagttctattccttagaagcaagtcatcaggttcagcccacactctagggaggaggttccacaagggcataaatacgagaatgagagggttggaagccacttagaggctgcctatcacgggcactgctgtctcttcctaagatggctaaaatataataatatttaacatttatctagcatttgcagttagtatatactaaacacggatgattcattaattctctcaacaaatgtgtgtgtgaggtattataattattccaattttacagacggggagaccgagtctcagaaaggtcaagtaatgtgcccagggtcacataacaagtaaaggacaggactgctatctgaacataagtaactcgctcagaggtctcaccctcccactcttgttttcctccaatctgctaccaacacaatagccagagcatttgctctgtcacccaggctggagtgcagtggtgtgatctcagcccactgcaacctccgcctcccaggttcaaactattctcatgccccagcctccttagtagctgggattacaggtgtgtgccaccacacccagctaatttttgtatatttagtggagacagggtttcaccatgttggttaggctggtctcgaactcctggcctcaagtgatccacccaccttggcctcccaaagtgctggggttacaggcatgagccactgcacctggcccagagcattcatttaaatcagacatgccatctcatttaaaaccctccaatcctattccactttaaataagttccaaatccccctactatgatgctgtgggctgaattatgtatccctcaccctaaccccctccaaattctaagtcctaaccctcattgtttccttccaaatcctaccttctttagagttagggcctctgtggaggtacttatgttaaaatgatttcatttgactgggccttaatccgatatgactggcatccttataagaaaggcatacaccgacacaagcagaaggcagaccacgtgaagacatagggaaaagtcagcattctacaaaccaaagagagcagcccagaacagatccttgtctcacagccctcagaaggaaccaaccctgctgacaccttgatcttcaacttctagcctttgaactgcaagaaaatacatttcagtcactttaagccaccctgccagcggcactttgtgtggcagctcgaggaagcagatgcctgccacttgctcctggctcacctaagccatggcagcctcctttcacttctttgcaaatactcttccatcttagggcctttgcatgtgtgttttttttctgcctagaacatttttttcttcttgttttgagacagagtcttactctgtcactcacgctggagtgcagtgacgtgatcatagctcactgcagcctcaacctccctgggctcaagtgattctcctacctcagcctcctgacgagctaggactacaggcatgtgccaccactcccagctaatttttttttttttttttttgagacggagtcttgctttgttgcccaggctggagtgcagtggcgtgatctctgctcactgtaacctctgcctcctgggttcaagctattctcctgcgtcagcctcctgagtagctgggactacaggcatgtgccactacgcctggctaattttttgtatttttagtagagatgggtttcaccatattagccaggatggtatccatctcctgacctcgtgatccacctgcctcggcctcccagctaactttttttgtagagacagggtcttgctatgttgctcgggctggtctcaaattcctgggctcaggagatcctcctaccttggcttcccaaagtgctgggattacaggcatgagccaccacaaccagcctctagaacagtcttacttcccttcctcaatgctcattccctcttattcctccactctcagcctcatttcacccctttagtgaagcttttaattcctttcttacctaaagagttctgcctgttgttctctaccctaacacactgtaaattttctttattgcacttaccacaatgtataattagacgtttctttgtttatttgttgcttttctctccccctagagtgtagagtctcaaggacaggaattgcatctgtgttatttgccagagcgtctccagcatacaacacagttcatggaacccagtgcgtgcccagcaacgatcagttgaatgactagagtagtgattctcaaccctggctgcacaggagagtcactcgggggtgctttaagaaacaatgatccttgattttcacccccgtgagatgctgagtcagtcccatgcaactagattgaggacaagaggataagggaaaccatttccttttcaatctgtgaaggtttgttacatttatggaaaacttgaacttcaccacagtcttacaggaagcatgaaattgagccttgagtttttttctcagctgtccaactgttatgggcctacaattgtatagctcagagtgacagagaagaactttggggttgggaaagaattggagcaacttcaagcaggaacgcggtgtggcaccttgggtgcatctcactgggttccatccattctatggtgttggggtcactctgctgtagagcaagatgcagaaatggccctctctactttccttatgtgtgtatgtgtggaggggaggtttagtggatgtctctggttactggaattctgtttgcattgcgctgccttctaggaccaaggactggttttcaagctctttggtcaagggagagagagcagtcttgagtctgtcagaacaggcccctgacaagtgaacagtattgatgccctccagccaaagacctccaggaacacacccatattgaacaagttgtgtttcatgttcattgcagcaagagaggacacacacatggggaaccatggaaggtgttggaaaggactcattatggaattggactttggttgtgtgattttggggagagtccaagcaagctgggatgtgcactggcatgggtgcagcctgaaagaggcaatgttaccattgactctctcaataaattttatctataaggaagggagggaaagcagactagagcgaggctaaaactatgattggtgaagaacactagttactcgcattcaccaggagaaggtcatgtttggcattttgtggcttgaacaatgttcctgttttgtctgtgttcacgtgtgattacggagtcttctttctgtcctgattcatcatgactacagagtggctttgtctaacattgatgctctgtgaaattgtttatgtttaggaaaacaccgagattgacctgtcagtaccaggccagttccctgctgtcaggggctgctttcctctttatcactagctttggatttgctccttccagtacttttctcatgtaaagtaaggtagtccagtgtgttcacacaattgagagcatttattacattagcctcctatcttttgcggggataatcacagcaccatggtgtggtaagtggcagtagagtatggtggttaagaacaaatgatcttgaggtcaggcgtggtggctcacgccagtaaacccagcactttgggaagccgaggcaggagtattgcttgagtccgagagttcgagaccagcctgggcaacatagcgagaccctgtctcttaaaaaaaagaacaagtgctctttattcagaaaatcattttagttgtgtgaccttgagcaagttcacttgaccaccctagcctcgactccctcatctgtaaaatgggggtaataatagtgcctaacttatagggcaattatgatgcaccaatgaaataatgcatgaggccgggtgcggtggctcacacctgtaatcccagcactttgggaggccgaggtgggtggattatctgaggtcaggagtttgagaccagcctgaccaacatggttaaaccccatctctactaaaaataaaaaaattagccaggtgtggtggtgcatgcctgtaatcccagctactcaggaggctgaggcaggagaatcgcttgaacctgggaggcggagattgcagtgagccgagatcgcgccactgcactctagcctgagcgacagagcaagactctgtctcaaaaaaaaaaaaaaaaaaaaaaaagcatgaaaaaacttttagcctggtatctggccagcagttggtatgctattgactaccaatgattcaatagaactatatgtttctctgcttagtttatcagagtttgcctttgtacctgtgatgaaaaaaacggtggaccgtaagaccttgggaccttggttccctgaaccaagccaggacaattgtattatttctcctggaattttgaaattggacaccaatatttgtcattcagggttggatatgtagactgggaagtgatgtcaagcgtccttgagtgaccactttctgctctgttgacttagaaccttgaggttaaaaaaatgttataggaaaccatatttgtttgaatgtttgttggaaagaaaagcagaaaagtagagaaaggtgatcttttttaattcttaattttttattattaaattttttttttattttaggtttgaggatacatgtgaaagtttgttacataaagatttgtcacagaggtttgttgtacatatcattacatcacccaggtattaagctcagtccccaatagttatcttttctgctcctcttcctcctcccaccctccccactcaagtagactccagtgtctgttatttccttctttctgttcgtaagctcttatcatttagctcccacttatatgtaagaacatgtggtgtttggttttctgttcctgcgttagtttgctgaggatgataggctccagctccatccatgttcccacaaaagccatgatcttgttcttttttatggctgcataatattccatggtgtatatgtaccacattttctttatccagtctgtcattgacaggcatttaggttgattccatgtctttgctatcgtgaacagtgctgcagtgaccattcacgtgtatgtgtctttatggtaaaatgctttatattcgtctgggtatacacccagtaatgggattgctgggttgatggtagttcttcttttagctcagaaaggcaatattcaaagacaggagaataaactggggtgagagagagaaggagtgaagaaaggagaaaagaagagagaagagagaggaagagaaggttctatggagctctaagtgttctatctggtctgcccgagttagtagagggataagaataaagaaaaaaaatgttactattcctctacggcccatcacacacatgggtgaatcaaatgggcaaagcaagagtagaattttacaccaccatgccgtaaacctggattgttttgactgttgagcatctcctctctcttttctattctttttctttctctttctttctttctttccttctttctttctttctttctttctttctttctttctttctttctctctctctctctctctttctttctcgctttctctttctttctctctttctttctctctctctctctctctccctctctctcttcttttcttttcttttgagacggagtttcactcttgttgcccaggctggagtgcagtggcgcaatctcggcttactgaaacctccacctcccgggttcaagcgattatcctgccttagcctcccaagtagctgggactacaggtgtgtgctaccacacccagctaattttgtatttttagcagagatggggtttcaccatgttggtcaggctggtctcgaacccctgacctcagataatccacccacctcagccttccaaaatgctgggattacagacgtaagccactgcacccggcctcactttcttttacccacatcagtcctgataatttccagtcccagcatcctgccttctccctcactcccgtagaaggactgggcaagtgaccaggccaatcagagttccccaatatcctggccatgtggattggtccagctatgggcacgtgaccttagctaagccaatcacctattcagaatgttttttgttctttaatacagagctgtgagagacagggtcttggcttttgaataatggggctgaaagaagtgagtcagggactgccaggggctgtctcctataccatgaggagaaatctcgtctatagggagaacgagccaaaagatggaaagtcattgagagggagagggagagggacattgaagtgggggagagaaagagagagacataatataatgttgagctttaaatcagctctatctagacttagaaaagccaataacttcccacttttcttggactgatttgagttggttttttgctactttagccaagtggtccccgtgatggctccccatttctttagatgaaaatcccaagccctcacgttggcatgccaggacacacctgccctagcctcaatggcctcatctcccgtccctctcgccattgcttactccgctgcagccattcctgcctccttgcttgttcgtcaaacgtgccaggccctacttcatacggattaaatcagactttttgagtgggatcaggacattagtattttatttgtttttaatttaattttatgttttgagacagggtcactctgttgcccaggctggagtgcagtggcacgaacacggctcgctgcagcctcgacctcccaggctcatgcgatccttctaatactcaccgttagctgggacctcagccagccagttaaccaaaatgtatgcgtgtggcctccccaggtgttctcttcacatgggctagttggacttcctcactacatggtggctggtgtgcaagagtgagtggctccagaaagcaaggaggacatgcctatgattttttatgctctagccctggaagtcaaatagcatcttttctgctgtaatcttaatcttaatgattgaggcagttgctaaggttcaagtggaagggatcatagacttcatcactcaacatgagaaatagaagcttacaaccacctgtcctcagcctcccaagtagctgggactacaagcatgtgccaccatgcctggctaattttttgaattttttggagagacagagtctcactatgttgcccaggttggtcttgaattcctgggctcaagtgatccacccgccttggcctcccaaagtgctgggattgcagatgtgagccactgggcccggccggtgacattggtatttttaaaaaggtactcagtgatttcaatgtgtagctagagctgagaatcactccttcagactaataaagaaggtcaatggctattaaggcaactaccctaaagaattaacttaaagtctatgtgtaagtttgtctcttgtcaacatagagtctagtttccttctaattttgattataaaataggaaagcattttcctatactataaaaaagtttgctttaagagtcccaggactgatttattatgaccttgagatttaaaaacatttattattggaaaccatgtttgtttgaaccatgtttgtttgaatgtttattgtagaaaagtccatttttccttttaaagtcataaactaaatttgttacaggaggttgattttgtgttccaagcctgtgatcattaactgttttccagctctaccaggtagggtattgaaccttttcttatttgagattcaaataaattctcctttaccaaaatgttattttgcaaataactaagtgactctaatggattaactttaaaatgcaatgccaaatcttgattttccacgaatgaataatttgaaagaaatttctctgttcactacatatacgccagaaagaatatcaaccttggcttttgatatattttaaattcctggttcaagtttcttatgtggccaaattgttcttagtgacctgggcttctgtaaaatgtccctgattcctttcataaaatgcttattttggcttatgctgctcgagtgagtttctgttaccatctttgataaagacaatcattaatcctgacagcagccttgcaaagtgagtcttactattcccatttcacagatggataatctgagcccttgggtactgagaaacttgctcaagtccatacaattaggcactggtagtccctggacaacaacccagatctacttgaccccaaagctgatgagtttccaccctcacagaaggtcctaatatggcacattgcttttttttacattgggatataattcatgtcttataaaactcaccatttaaaagtgtataatttagtggtcttagtgtattctcaagatttttcaactatcaccactgtctaattctaggatgttttcatcaccctccaaccccagacctctaccattaagcagccactctttcactcctgtcccccagcctctggcaaccactaatttactttctgtctctatggatttgcccattctgggtatttgatacacatggagtcatacaatatgtggccttttgtgtcttggttctttcacgaaacacagtgttttctaatttctaatttctacatttctgtcgtagaatatatcagtacttcatttctttttatggctaaataacattccattgtatggatagaccccattttgtttatttatctgtttacagacatttggattatttccaccttttggctattataagatacattttgtaaataacattgttatagaagtcttgttttccaaattaaacagaagggcaggtcctgtttcacacactttttttttgtattaaaaatatatgagggctcttccagttgctattactgggtaacaaatcacaccaatttttagtgctataagccacaattttattacactcacagatcctgtaggtcaagaatcagaccagagagggtggcttgctctgcctcatgatgtctggggactcagctgggaaaactcaaaagttgagggtgacttgatggctggggactaaaggcatctagaggaatcttctgtcacatgcctgtatttcatactcactgttagctgagacctcagctagccagttagccaaaacgtctgcatgtggcctccctaggtggtctcttcaggtgggctaattggacttcctcacaacatagtagctggggtccaacagtgagtagctcaagaaaaaaaggaggaagtgcatatgctttttatgttctagccctggaaatcaaatagcatattttctgctgtaatcttaatgattgaggcagtttctaaggttaaaaggggagggatcatggacttcatcactcaacacgagaaataaaaggtcacattatgacagcatgtggtatgggagatatcactatggccacctttggaaaaaaaccatctgccacaaggaccttgcactgggcttgtgacaggtatccagtagatccttatttaattaaatatattcatgcttatcaacaaattacatattggcctgcctgcttgtttgttcatgaatccatctcctccttcagaaatgaccccttcttgggtattattctaatgctttcatttcttaacttctgcattttcctagcttaggcaaatcactttacttctcagagcctcagttgtcttacccataaaatgggcaaacacatttgttcccactctacaaaattagtttgggaattcagtgggctaaggtataaatagtgcttactttagatgctgtttggaggtaaaggttcaataaatgataactattattattgctgttgtgattacctgaatgtaatccccattctcttatacttttcagcatcctgtccaagcctttaagatgaggaacaaattctatgtgaggagaaatggcaaaaattggtatgcctctgcttttctgatttcccattcccttccatttctcttattaacaagtaaaagtaaggaaatcctgtcctgtggataacttcccattgacttgcagagagctcagacatgctatggtagatatggatactattttgtttttgttttttgagatggagtcttgctcagtcacccaggctggagtgcagtggcatgatctcagcccactgcaaactccgcctcccaggttcaagtgattctcctgactcagcctcccgagtagctgggattacaagcagatgccaccacacccagctaatttttgtatttttagtagagacaaggtttaaccatctttactaaacagactaggcccgtcttgaactcctgacttcaagtgatctgcccgcctcagcctcccaacgtgctgggattataggtgtgagacactgcaccttgccaatggtgaatattgttgatttaaaataatagatataataaatctccaatctcagggaagtttccaagtcctaaagtcaaaacttccgatcttgccgtgtgcttgaattatcctcaattagagtccctgctgctgttgcatgtcgctgtaattattctgtcatcgttaattcaatgaagcctattaacccacatcagatagtgtatttatctacaatgcatgttacctgctcctctagataagacagctgtcatacttcaagtctgctgtctctttgttgaggtccagtagtgtcagtctgcaagtgtttcatgtttcatatacattacagaatccccattaatggttgatatgattaggctttgtgtccccacccaaatctcatcttgaattacattccctataatccccacatgtcaagggagagaccaggtggagataattaaataatgggggcagtttcccccacgctgttttcatgacagtgagttctcacgagatctgatggttttataaggaacgcttccctctttgctcggcatttctccttcctgctgccttgtgaagaagatgcattgttttcctcttcactttctgccacaattgtaagtttcctgaggcctccccagccatgctgaactgtaagtcaattaaacctctttcctttataaattacacagtctcaggcagttctttacagcagtatgaaaatggagtaatacaatgatgttcttataacttcccagactggaaggcttgctggtcttgtgagatactgaactggagacagcagaaaaatgcatcctcctgatattgtgagcaacctcctctcttcttccctctctcctcttcttccctttcttctgttttcccttctaggagccaagagcataggctctggaaccagcctgcctggtttgaatcatgcctctgcctggggatcttgggcaggttgcttggtctctctgagcctgtttttttcatctgtgcaagaatcacaactctcttgtgagaatttaatgtgctaatctgcataaagcacatagacaactgtctggctcatgatgggagtgtaactgtggttatttcttcctattttcttccctcccttccaacagaagaaagtctctgagatgcgtgtcttatgtggcatatgctggacttggtgcctggggttcattggcagactagtccctctggtacctccagcaaggaagatagatgttaattattaattgatacccattgtgataaatctcacaaggtaccatgaatgggtataacagctccctttctgtggaggaggtggaggtgataggtaagacttcctggaggaagtaacatttgaacagagatctgaaagataaaatacttccaggaggagtgtgtgtgtgtgtaagtcagtcaacatcagaacacctccagcagtggaaacagtgtataggaagctctgaagtaggaaggatcctctgttaatggtttttttgttgttgttttccctcttcgagacagagtctcagtctgttgcccaggctggaatgcagtggcacagtctcagctcactgcaacctctgcctcccaggttcaagcgattctcgtacttcagcctcctgagtagctgggattacaggtatgcaccaccatgccccaatcattttgtattcttaatagagatagggtttctcaaactcctggcctcaagtgatccgcctgcctcagcctcccaaagtgctgggattacaagtgtgagccaccatgcctgacccattaatgttttgaataggtaatactttcgcatggtccaaattccaaaaaatacaaaaggataaacagtgaaatgtctccctttttccatttaccaccttccccctacctctatccctgaagcaacaaatgaaccaatttctttggtattcttctagaaatatcctgtgcatacataagcaaaatgtatgtgtgtatggtgtatatacatatatacacacactatatatagtgtgtatatgtgtatatatatactatatatagtgtgtatatatatacactatagtgtgtatatgtatatatactatatatagtgtgtatatgtgtatatatatactacatatagtgtgtatatgtatatgtgtatatatacacatatatatactatatatagtgtgtatatgtatatgtgtatatatagtgtgtatagtttatgtatatacatatccacactatatatagtatatatatgatattcacatatcatcttttattttttaatatgaaaaatgcttctccgttatttgcttttttcacctttctcttaaatacgtatcttggagatccttccttatgagtacacagttaactttcttattttcttttctgagtggcagagtacaccatgtagtaccctataatttgtttaagcaacctcctactgatggatgtttgggttatttctactcttctgctattatttaaaaaaactataatcgataatctgataccggtgcaatttgctcctgtgcaactgtctgtgggataaatttctaaaagtgtaatagttgggtcaaatgacacacttttctccacagaggttgtaaaaaatttacacccacccctcaaggaatgtttgagttcccatagtggcatcaagcaccatgtattattgagttctttttaattttgccaatctgataggtgaaaattcatatctcagcatagttttaatttgcatttatcttactctgaataacacagagcgtgttttcatttgcccaagaatcacttgtgtttcttttcttacgaactgttcttatcttttgtccatttttctgtgatgaatctgctcttttgcttattgattttatacattaggggaattagccattttccacgccatgcttcacaaacattatttcctgggttttcttttgtatttagactttgcttagggtggttttggttctgcagctctgttttttaaaaaacttttatgtagtcaaatttttttttttggggggggggtctcctggatttgtgacatacttggtctcctgcatttgtgacatgctaagaaaaacctttgtcatttcaagatcataagataattctattctttaaaaaaacaccttcagaaaaggggattccagatgcgactttaatgatcctttcctgtgtttgccaagcatcatggtagaaataccttccttatagccacatgaaacccctgatgctggagtgttgtgttcaccttatcggcaaatatttccccagcacctcctatgtgtcagtgtagaactgaacagcacagaagctacaaagactaagaagccagcaaaagttcaaattccaccacccagaagtaaccaccataaacacttggtattatcatgaattttttttataaaaaactccataagcacatatttttaagataaaaataagattattgtacacataatttttctgacctgatttcaaaatatatccaagacttctttctctgttactaactgtaaatgtagatttaacatttaacatttaactacggcaatgatttacatgtagcagggtttgtgaaatgactccttgtggatggacagtgagactatcctccctcttccaccattctaagcaatgctaccaagaacatctttacatgtctatctttgccctcttgtcttagacctagaatttctgggtcacattgttaaactgtttttaggaagattgtgctgacttatattcccacgagcaatgtaaggtatgccagaaagagggcaggaggttgggagtgggaggagaagggggcggaggaggaaactgggtaaatgctattggtgataaaaaggagacagtctcactgtctatcaatagggaggtcattcagcaaatcctgctacatgcaaatcgttgcctagtcatgaaatattaaatgttaaatctacatttacagttggtgacagagaaagcagtcttggatttattttgaaattaggtcataaaaattatgtatgcaatcatcttatttttgtcttgaaaatatatgttcatagagtttaaaaaaatcattcatgataaataccaaatgtttatagtggttatttctgggtggtggcatttgaactgttttatttttattggcttttttttttttttaattgagatggagtcttgctctgtcaccccggctggagtgcagtggtgtgatctaggctcactgcaacttctgtctcctgggttcaagcgattctcctgcctcagcctcctgagtagctgggattacaggcacccgccaccatgcctggctgatttttgtaattttagtagagatggggtttcactgcattggacaggctggtctcgaactcctgacctcaggtgatccactgccttggtctcccaaagtgctgggattacaggagtgagccactgcacctggaattttattggcttctttattcatctttgtagtttctgggctgttcagttgtatattgacatatagtaggtgcttgggaaatatttgctgatgaaggctattttgggaattaaaaaaatgtatttcagggggcagcaaactatagctctagggccaaatctggtctctgcctatttttgtaaataaagttttattggaacagcctcatacacctgttcatttacatagcatcagtgattgctttggccctacaagggcagagttaagtgattgcaacagagcccacatggtcaaaagagcctcaaatatttactaactgatggtttacagaaaacgtttgctgcctcctggtttatttcattaaagaagttatattacacctctttggtgtctccattccctttaccacttatgttaacgtgggaatgatgacaccaacctggaagagtcacatacgtaaggcatacagcccagtgtttgtcttttggtgcatgtataatcaatactaattcaccttcccttcctaaagacttttactcccaggaagtggaagcagaaaatgggcaggtatgaggcaccgggttggtgatagttcttctctgcttttacttcccattttctgtcccaaagtttgaggagttcattttttcccttctgagtaaaaaaaattttttttttttttgagacagagtcttgctctgttgcccaggctggagtgcagtggcatggtctaggctcactgcaagctccgcctcccaggttcaagctagtctcctgcctcagcctccctagcagctgggactacaggcgtgcaccaccactcccagctgatttttgtattttttgagtagagacagggtttcaacatgttggtcaggctggtatcgaactcctgacctcaagtgatccgcccaccttggcctcccaaagtgctgggattacaggtgtgagccaccgtgcctggcttctgagtaactttcaaacacctgaagccccaaacttagaagtcacaagaatcatgtcaagcctaataaatgactgttttttcctgttatcaaactttttagggaaacaggatttctgtcacttacttggactgaataacactcacacatatttaaaaaacattgtagggagtgttttggatggatggtatcaaggaatagggggtctgcagttgtcatgcacattaagcagtggcattgaattagggtctgtgggaaatctggtagtatcagagcatgcaggcttctcaacctctgtactcctgacattttaagctggatgatcctttgttgtgcgggctgcaggatgtctacctggtgtggtagacagaacaatgccccctctcctcaaagatgttcatatctcaactcctagaatctgtgaatatattacattaagatggcaaaatccaaacgaaaacaaagcaagagaaaactctcgcagatgtgattggaatgaaagatcttgagatgaggagattattctgagttattcaggtgagactcaggtaattgcaagggtccttagaagatgatgtgacatgatgatagaataagagtgggaagagaagatgttaccctgttgctttgaagatggaggaaggagccatgagccaaggaatgcaggcaacctctagaagctgggaaaggtggggaatagattctcccctagagcctccagaagacatgcagccctgtggactcatttttgtcttctgacctctagaattataagaataaatttgagttgtttaaaaccacttaattggctgggtgtggtggctcatgcctgtgatcccagtgctttgggaggctgaggcaggagtattgcatgagcctaggagttagagactagcctgggccccatctctccaaaaaataacaattagctgggtatggtggcatgccctgtagttgtagcaactcaggaggctaagatgggaggatggcttgagcctaggaggtcatggctacagtgagctatgatggtgccactgcactacagcctgggtgacagggcaagaccctgtctcaaaataaaaaaataaaaatgaaaccactaaattcatggcaagtttttacagttacaataagaaatggttacacctggtctctacctactggatgccagtaacaccgcattcccctcaccccactctttttttcttttcttttctttttttttttttgagatggagtctccctctgtcacccaggctggagtgcagtggcgtggtctcggcccattgcaacttctgcttcccgagttcaagcaattctcctgcctcaatctcccaagtagctgggattacaggtgcccgccaccacgcctggctaatttttgtatttttttaatttttattttttattttattattattatactttaagttttagggtacatgtgcacaatgtgcaggttagttacatatgtatacatgtgccatgctggtatgctgcacccattaactcgtcatttagcattaggtatatctcctaatgctatccctcccccctccccccaccccacaacagtccccagagtgtgatgttccctttcctgtgtccatgtgttcttattgttcaattcccacctataagtgagaatatgtggtgtttggttttttgttcttgcgatagtttactgagaatgatgatttccaatttcatccatgtccctacaaaggatatgaactcatcattttttatggctgcatagtattccatggtgtatatgtgccacattttcttaatccagtctatcattattggacatttgggttggttccaagtctttgctattgtgaatagtgccgcaataaacatacgtgtgcatgtgtctttataacagcatgatttatagtcccttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttcaatgatggccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctagatattagccctttgtcagatgagtaggttgcaaaaattttctcccatgttgtaggttgcctgttcattctgatggtagtttcttttgctgtgcagaagctctttagtttaattagatcccatttgtcaattttggcttttgttgccattgcttttggtgttttagacatgaagtcctttcccatgcctatgtcctgaatggtaatgcctaggtttccttctagggtttttatggttttaggtctaacgttgaagtctttaatccatcttgaattaatttttgtagaaggtgtaaggaagggatccagtttcagctttctacatatggctagccagttttcccagcaccatgtattaaatagggaatcctttccccattgcttgtttttctcaggtttgtcaaagatcagatggttgtagatatgcggcattatttctgagggctctgttctgttccattgatctatatctctgttttggtaccagtaccatgctgttttggttactgtagccttgtagtatagtttgaagtcaggtagcatgatgcctccagctttgttttggcttaggattgacttggtaatgcaggctcttttttggttccatatgaactttaaagtagttttttccaattctttgaagaaagtcatttgtagcttgatgggtatggcattgaatctacaaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgattttgtatcccgagactttgctgaagttgcttatcagcttaaggagattttgggctgagacaatggggttttctagatacacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgcccgttttcaaagggaatgcttccagtttttgaccattcagtatgatactggctgtgggtttgtcatagatagctcttattattttgagatacgtcccatcaatacctaatttattgagagtttttagcatgaagggttgttgaattttgtcaaaggctttttctgcatctgttgagataatcatgtggtttttgtctttggttctgtttatatgctggattccatttattgatttgcgtatattgaaccagccttgcatcccagggatgaagcccacttgatcatggtggataagctttttgatgtgctgctggattctgtttgccagtattttattgagaatttttgcatcaatgttcatcaaggatattggtctaaaattctcttttttggttgtgtctctgccaggttttggtatcaggatgatgctggcctcataaaatgagttagggaggattccttctttttctattgattggaatagtttcagaaggaatggtaccagttcctccttgtacctctggtagaatttggctgtgaatccatctggtcctggactctttttggttggtaaggtattgattattgccacaatttcagagcctgttattggtctattcagatattcaacttcttcctggtttagtctttggagggtgtatgtgtcgaggaatttatccatttcttctagattttctagtttatttgtgtagaggtgtttgtagtgttctctgatggtagtttgtatttctgtgggatcggtggtgatattccctttatcattttttattgcatctatttgattcttctctcttttcttctttattagtcttgctagtggtctatcaattttgttgatcctttcaaaaaaccagctcctggattcattaattttttgaagggttttttgtgtctctatttccttcagttctgctctgattttagttatttcttgtcttctgctagcttttgaatgtgtttgctcttgcttttctagttcttttaattgtgatgttaggatgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgagtttcttaatcttcagttctagtttgatcgcactgtggtctgagagacagtttgttataatttctgttcttttacatttgctgaggagagctttacttccaactatgtggtcaattttggactaggtgtggtgtggtgctgaaaaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtagatcactcaggacttgctttatgaatctgggtgctcctgtattgggtgcatatatatttaggatagttagctgttcttgttgaattgatcccttgaccattatgtaatggccttctttgtctcttttgatctttgttggtttaaagtctgttttatcagagactaggattgcaacccctgcctttttttgttttccatttgcttgttagatcttcctccatccttttattttgagcctatgtgtgtctctgcatgtgagatggtttcctgaatacagcacactgatgggtcttgactctttatccaatttgccagtctgtgtcttttacttggagcatttagtccatttacatttaaagttaatattgttatgtgtgaatttaatcctatcattatgatgttagctggttattttgctcattagttgatgcagtttcttcctagcctcgatggtctttacagtttggcatgattttgcagtggctggtaccggttattcctttccatgtttagtgcttcaggagctcttttagggcaggcctggtggtgacaaaatctctcagcatttgcttgtctgtaaagtattttatttctccttcacttatgaagcgtagtttggctggatatgaaattctgggttgaaagttcttttctttaagaatgttgaatattggcccccactctcttctggcttgtagagtttctgccaagagatcggctgttagtctgatgggcttccctttgtgggtaactcgacctttctctctggctgcccttaacattttttccttcatttcaactttggtgtatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccctatcactttcaggtacaccaatcagatgtagatttggtcttttcacatagtcccatatttcttggaggctttgttcgtttctttttattcctttttctctaaacttcccttcttgcttcatttcattcatttcatcttccatcactgataccctttcttccagtcgatcgcattggctcctgaggcttctgcattcttcacgtagttctcgagccttggctttcagctccgtcagctcctttaagcacttctctctattggtgattctagttatacatttgtctaaatttttttcaaagtttttaacttctttgcctttgctttgaatttcctcgtgtagctcggagtagtttgatcgtctgaagccttctctcaactcgtcaaagtcattctccgtcaagctttgttctgttgctggtgaggaactgcattcctttggaggaggagaggtgctctgtatttagagtttccagtttttctgctctgttttttccccatctttgtgattttatctacttttggtctttgatgatggtgatgtacagatgggtttttggtgtggatgtcctttctgtttgttagctttccttctaacagacaggaccctcagctgcaggtctgttggagtttgctagaggtccactccagaccctgtttgcctgggtatcagcagcggtggctgcagaacagcggattttcgtgaactgcgaatgctgctgtctgattgttcctctggaagttttgtctcagaggagtacctggctgtgtgaggtgtcagtctggccctattggggggtgcctcccagttagggtgctcgggggtcaggggtcagggacctacttgaggaggcagtctgcccattctcagatctccagctgcgtgctggaagaaccactgctctcttcaaagctgtcagacagggacatttaagtctgcagaggttactgctgtctttttgtttgtctgtgccctgcccccagaggtggagcctagagaggcaggcaggcctccttgagctgtggtgggctccacccagttggagcttcccagctgctttgtttacctaagcaagcctgggcaatggtgggtgcccctcccccagcctcactgccgccttgcagtttgatctcagactgctgtgctagcaatcagcaagagtccgtgggcgtaggaccctccgagccatgtgtgggatataatctcctggtgcgccgttttttaagcccgttggaaaagcgcagtattagggtgggagtgacccgattttccaggtgccgtgtgtcacccctttctttgactaggaaagggaactccatgatcccttgcacttcccgtgtgaggcaatgcctcaccccgctttgggtcacacacggtgtgctgcatccactgtcgtgcgtccactgtctggcactccctagtgagatgaacccagtacctcagatggaaatgcagaaatcacctatcttctgcatcactcatgctgggagctgtagaccagagctgttcctatttggccatcttggctgccaaactaatttttgtattttttgtagagatgcaatttcgccatgttggccaggctggtctcaaactcctgacctcaagtgatccacctgccttggcctcccaaagtgctgggattacaggcatgaaccaccctgtccagcccccattcccaatttgtgatcaccaaaaatgtccacagacattgtcagatgctccttggggagcaaaatggttcccagttgagaagctctgtgttagagagattccaacagcagctgcaaaaactcagatgcaagaagttggtgcctgcactcagctgagtgcagtcagtgggctgtggggagctgggagaataggtaacccatcatgctcactgttgctcctctctgctgccttgccctgtggggattcatgcctggatgcttggagagcatggttgggctgaccaagaatccttattgaatgtgacaagttgccccattgggcccctgcttcttagcccaaggatgaaagtcactctttgtggcagcttttccctttgggtcagactcctttgcctgactgaccaattcctttcatgctggcaggaaggacttccttctatctaagccacagtagctaagtgttgcctggttccatgcaatagaaactgactctgattaagtaaggaaaataaattcgtgattgttaggataacaggtgctctcactgaatgagagaggagtttgcataggaaggaaaatactaatagagttttggaagcttagcagcagatggaattcatgatctacctctcttaaaaaaattttttttagagacacggttttactccatcacccagaccagaatctagtggcaccatcatagctctctgtatccttgacctcctgggctcaagcaatcccgctgcctcagccttccaagtagctaatgccaccatgccaccatgcctggctaatttttaatttgctttttgtagagacagggtctcgctctgttgcccaagctggtcttgaactcttggcctcaagcaatcctcctacctcggcctcccgaagttctgggattagaggcgtgagccacggcccccagcccctacctttcttgagttctaccattaatgtgtctcactttccaatctcggattccaagtttcaaattcctgggggagagaatcctattgcttgggctccatagatcaacccactgagaccatggggagagacttgcccaaggtcacacagcctgaatagcagagctgggctgcctctctcgactttcaggactgttctttttccatgatagtttttggggagatggaattgtctagttagagagttacctgagagccaatatagtaagaaaagttcctcgccaggcaactgaaatgacacaggaactgaaaactgtggacaaactcgggctgttttttctagtaggtatcaggcatcaagatgtttttagataactagagatgacatttactttgacatattgaaaaatagttatgacagagttttgagaggcattattgtgaaccatagtagtgtgaggtcttaaaaagccccttcttcattttttagctgtttctaatttccacctaaattgtctcagatcctttgctaattgccaagcctgattgaatttccagttccttattcctttcctgggaccactttaggctctgactgacttctccttaggtctctgtttaaacaccaccattacaacaggttttatttagttttttttttttttctttttaagacggagtctcactctttcgccaggttggagtgcagtggtgcgatctccactcactgcaacctctgcctcctgggttccagcgattatcctgcctcagccttccaagaagctgggactacgtgtgcacgccaccacgcctggctaatttttgtatttttagtagagatgggttttcaccatgttggccaggatggtcttgatctcttgaccttgtagatccatccacctcggcctcccaaagtgctagaattacaggcatgagccactgtgcccggcccttatttagtttaaattcagcaatcaattcacatttactatataaaaattcaaaacacagatatgccaattaaaatttaaaaaatcacccataagctgaccatctagaaaaaactgtacatttctctattccgcatccttctagattatttttcttatcagtttatacttatgcaaagtggtattatacttcatcttctgttttgttactgactttattcatttagttattaaaactccttaaatatgtgttgattacattgtttacttaatttttttctttttattttttttagacaaggtcttgctctgttgcccaggctggagtgcggtggtgcaatctcgctgactgcaacctccgcctctcaggttcaagtgatcttcctgtttcagcctcctgagtagctgagaccataggcatgtaccaccatgcccgctaactttttgtatttttagtagagacagagttttgccatgttggccaggctggtctcgaactcctaggcacaagtgatccacgtgcctcagcctcccatgttgctgggattataggcgtgagccattgcgcctggccaattacactttttaatagcttcaaagcattccattccctggttatgccatgattgattgaacatatccattattcatttttgagagaacttttttgtttctgtgttgttgatggagtgatgttatatagctgcagaataaatcaaaccatgactaatatttcataatttcatgaatttatttcattttggatagttacccaattttttttggtcctttctgattttagaatattttgttatgacattcctttgtgacactggggagaaaatgtacttttttcccaggtcagaggtgtccagtcttttggctttcctgggccacattggaagaagaagaattgtcttgggccacacatagaatacgctaacaccgacgacagctgatgagctaagaaagttgatgaatttatgttgagccccattcaaagctgtcttgggccacaggttggataaccttgccctagtttctctctatgcctttgagctgccattcagactcctttgaaagatggattatcttatatatacctatgtattttctgatgcccactctccccatttgactacctgtggagttgaaaacaagtccgcctactctaatcaaatcatgatgctctgtccggggtcacattttgtaaccgacaaaacagtgcatgaggagttccggttttctcgtatcacaagattttattgagcagctactatgtgccaggcagtgtgctaggctttggagacttgtacaaattatcctggggtatctcagcagggaagtccttatttgtttattaatttttcctgacggtcaggtccagttagtctcactctaaacctggggcttggaatagagggacctgagacaccacattagctgcatgacattgggtgactagattacattctttgtatccattttcatattgataaagttaaatcggctcagagtgagggttataactctagcatatatagaggccacagcatatagtgttatatgctgtacaaaagacacaacacacagtaaatgattcaataagcaatggccatctttattatttacgttgttatcatattctgctgaaaggcttatgtatcaagtacaagaaaatgtataacccagtcatttgttttttatccaaggcagctgatgaagaagacacttattagcccaaagagtgaacagggtgagaggaggaggttattggctgcttctctgcggttaatttagccatcatttcagaatggagctggtatgctttgagtgtgaaagaaacctgctgcttgttgatgattagtctggttttaatgagttatcaggtgtcaataacagcagaagtgcactaacttttcacagccatcagaggatgttcaggatgttcactgggttctcacttttcagggttttctgtgggtgttagaggttgggctgaggagggcctgataggacatatctatctctgcaagtcttaggcaaagaagctttcgtgatgatgtattaggctgttcttgcattgctgtaatgaaatagctgagactgggtaatttataagagaagaggtttatttggcttacggttctgcaggctgtactggaagcatagctccagcatcagcttctagggaggcctcaagcttgtaatcatggtggaaggcaagggggaggaggcatatcagtaggtggggaggtgccacatacttgtaaatgatcatgtgtcgtgtaaactcactcactatcacaagaacagcaccaaagggatagtgctaaaccattcatgagagatccgcccccatgatcccaatacctcccaggaggccccacctccaacagtggggattaagtgagagttgggtggggctccttgctcctcttcccagttaatccttaatctccaccccaactccaggcaaccactgaacttaacctccccttccccttcctctccttcttccccttccccttcccctccctgaggtgtctgtcagttacccagactagagtgcagtggcatggtctttgctcactgcagcctctgcctcctgggctcgagcaattctcccacctcagcctcctgagcagctgggactacaggcacataccaccatgcctggctaatttgttgtatttttcaaagagatggggtttctccatgttgtccaggctggtctcgaactcctggggtcaagcaatccacccggctcaacctcccaaagttctgggattacaggcatgagtcaccaggcctggcccactgaactactttctatcccaatacattagatttttctttctaggagtttcatatgaatgaaatcatacagtatgtgctcctggcttcttttgcttagaataatgctttggttattcatctgtgctatttattgtgtgtatcagtcatgtttttctattttctcaccttgagaagtattctgttttatagtacaaaacaatgagtatgtccattcaccttgaggaagattttatttgaagaaatctttgtcatcaaaaagcttgaaaaccagggctctaccttgatttcatagtcttgagaatgatggagaactcaatttataccatgattttcattgagaaagcaggttgcatgttaagagattaggtgataggatgactgaaaggtatttgtgatcttatgaaaggtacaatgtggcaggcagcctctatgagggaccccagtgatccctgtctcctggtattcatgcctttgtgtaataccctccccttagcatgggctggacttactgactcacttgtagtgaatgcaatatggctgtcctgatgggctgtcacttctgaaattagcttatgaaaaaaccgattacaggtatatctcattttattgcacttagctttattgtgctttgcagttattacattttttacaaataaaaggtttgtgtccctcagtcaaacaaaaatgcaatgggtttctttctagtcccccacctcaattttagaaattaaaaaattttccaaacacagtgagtagtagtctatatctgaagggtgaatgaagcaatgagtgaccaagttgcccacttaaggaggcacttcacaacaataaacaaagagcctgctctttggtctcagacctgggtttgagttctaactctgctactccttgactgtgagatcctggccatgtgacttaccttctctgagcttctattttctcatctgtgaaatggggacaataattcttacatcagtgcattaagtgagagaatctagacagcacagtacctaacacaacacaatgactcaatttattattgttgttgttgcttcattcttatttgtaaacactcaactgtcttcacaaacttcaggagctcttcaatgagacactgtgtccattaacagtctcatccaatgggtaatcttgaagatagatgattctatggtaggttctgaaacatctcctcttttactctatcatggtgtcaaagaccaggatggtacagaggtccaggagtctggcctatgcagtcagagaaactgatttgaactctacctcttccacttattaaccaaggggctttgggaaaattgtgagcatcaccaggctcatggtgaagatggggttaataatagctccaaccttatggccttaattgagataattaatgcatataaaaatgaaaccatgtcttttgcagcaacatggatagaactgaaggccattatcctatgtgaaataactcagaaacaggaagtcaaatactgcatgtggtcatttataagtgggagctaaacaatgggtacacacagacatacagagtaaaataacagacactggagtctacaaaaggtgggaaggtaggaggggagtgagggttgaaaaattatctcttgggtacaatgttcgctgtttgggtgatggatacagtagaaacctagatctcatcataatgaaatgtatgcggttaagaaatctgcacctatatcccctaaatatatacaacttttaaaaaattaaaaaaatgattaatgtgggccagcacacagtgatcactcaacaaatgcaaactcttattcttgtaggagttgagggaagatgccaagaccaccccttctccaacttttaatgtcctggtattttgtcttaaacatttggaagcatctgcaggcagggattttgtcctcctgtctcccttccgatggcactggcctgtttggatcagtggaaggctctcctgcccctcctcctttcttcccagaggttttcttttgcactttggacttctattcatggatccttctgccagggacgtggaccaagaattcttcctcttttgcagatttcttcccctaattgtcctgttttgtgctgtcacccctgtgctctccctcctccccagttatcagcagctggcaggaaatgtttatagaagaagcctttctttctgtttttaatagcctcctaggctgcaacctcccaaatgagaaccttgttaaccagaaggactctaggctactgatttatatttcagtcataccgagaggaggaaaaattacaaagggagaaagaaaaatgccaatgtacacatggactagttccgacatcttctctgatgaagaatgtatatatctattcaggctctggatgctaagggattccttccagatctcagtatttgacctcttacttttgggtcacgtggattcttcgtgcctcttgtgggcttgctgaaagcaaaagtaacaatttcatactcttgccattgaaacaaggggtctattacttttaaatcataagggcacttgtttcaacagaaatgttagtatcttggtgaagatggggtctaagttcttggtggcttctgaggatggcgaagggctcaccttctgtcatcccgaaccatcactgatgggacagtgtctctccatgtgtagctatgcaaaggccacagaacaaatgggtaaaaatatttggtggtcagaattctagctcaatagtcaaggaaggcttcctggaggagaaagttcattttgaactgggctttaaaagttggtgtcacagaaaatgcaagctgtccctcagaattaagactagagttctgtgaaatagtgattgcaaaaatggccacaattattctcctctctataggcacacccctttgcaatgtgacattgtagcttctcctattagagtctatttccccacccttgaatccaggccagtcttgtgacttgctttggctaatacagtgtgatggaggtgacagtgtgccagttctgagcctaaatctcaagataacttgcacacttccactcaatctcttggaatcctgcccaaccaccatgtgaaccagccccagctagcctttgggaggatgggatgccacatggagaggagacagcccaggtaaggaccagtcagcacccgaccaaccaggcagctaactgctggtacctgagatgggcccaatcaagagcactacatttgcccagatagacccagcgcacattgccagcctgcagaatcatgtgctaaatgaatgcttattgtttaaagctgccgaatagtggtttgtgatttagcaaaactaactagtacagtttcctatgcagctgagtgtatccatgtgactaagtttctacatacaaaaacggtgtgtgtaatttctggggaatttccttccagggagaaggtatgctcttcttccactttttttcctttatattgcctggaatgggtatgtaatagctggagctccagcagccatcttggatcatgaagtaagtttaggaatggaagacactcctggcagagcaataagctgggagggtcttgttcctgtaaaaccactgattacctttccagttctattctggtacttctaaatttactaaacagaagttaataaacttttgtttaggtcattgttttgagttttgcagttactcatagctgaacctattgcaaaagaatacagatggtcaggatttaaacaagcagggatggcagagaagggcatccatgacatagggaatataacactaatgttgcagagaaagaaaaagtgtgggtaatgggtgggcaatggtgaataactacatatgcctaaggggagcagtgggtgatcaaattgggaaccatttgggaccagcttttgaaaggcagactgagaagtttggagagggtggtagacaaaaatgtgtgagtacttatgcaaatcagagtaagaaagtcatatattcatttttcccccactcattgattcatttcttctaggaagtttacactgtgtatgagggaaacatagcaaaatagaaagatgattattgattgttatgcatggtctgaactaaataaactctgtgatgtggcagagattaactgttgggcggagatggctactttaggcacagtagtcagaattttttgttttctagaaattctgttaggccctgtgcagaagtctaggaacacagggatgaataacacacacttcctgtcattgaagagatcacaatctggtgtggaatgaggttaatcaggaatattttcctagtggaggtagaatagagccaaaggaaataatgtagttttcccatatgtatctgtcagatattgctacaacaaggttgcataacaagcatccccccaaatcttgcttacaacaaaaaaatattttttccttcacaggtctgtgcataggctgtggttctgctgggctctgttggctcggcttgactccacgctgtgggttggtctgggtctgctctatatatctttttattctgggaccaatggatcccaaagatttgtacttctcagggtggatggcagaagtgcaaggggccaaaccagaccacagaggcacatataatgctttgacttgcatcacatgtactaacacaattggcattagcaagactgatatcagtgggtcaggatgtatgttccactcacagtgggaagattgcaaaggtgcaaagatgtataattctgttaagagagggaatgaagagtcgggaacaatatccagcttaccataccacccagcttacttaccattccttaccatacaaggaaataatgtatttctccatttttcaagaacactcatgtctgaatagttttattattttcttcaacaaatcttttatcttgttagatttattgcaacgagccatatttctcttttttacaaaatttatttagaaagttacatatgcacatatggtaaaaagttcaaaaagtggtaccaaaagatataacagtgaaaataaggctggttcttgtttttatccactgaggcaaatactgagtttattttcaaaggtattctgtgtgggcacaatcacgcttgcatatgttaaaaaatacaaaatggtatcatacttgttcctctgcactttcttttttttctatttaacaacatatcttagaggtagtcctatttcaatttagctagacccatttcattctgtttaatggctacatttgtttttcattgtgagactgtgccgtaatttatttaatcagtgccatattgaaagacatttggatcgtttcccagcatttgcaactataatcaaggttacattaaatatcctgttacatgcaggaagatactttattcacatgcatgggtatatcagtaggttaaaactcaaatacagaaactgccaggtcaagagatacacatcttaaagtttaatagatattgaccctgtttctaaaaagaaagattccttccagcgtgtctacacacatttgtctgctcctctgtcttctgattcttgtcccatggtgttattttaggctgaaataatggaatatggtggctcaaaaaacttattcccataggatctctgggaaagctttgggtcttgccacatggtccccagttgaacacaggaagtacttggcactgttgttgcaacccaaatcatcactttaatgagcgtgctggaggagcgtggaatgtttccacaagcatgtgtactgaagaattccatgctgcaggcgaaatgatttatatccctgggagttcccagtaaaaaaatgtgcacagtaccctttaatttgatctgctttccctgtagcacctaaatatttagggcaaatagaaaatagttctgatttacatctctataaaaattttaaacaacctaacaagacatttgatcatgaaattgcctgaaataatgttggcactagtcagccatatttcttcaaaatggcctgtaacttcagtgcaaactcccaaacatggatttttttttcctgctaataacagtcttattaataaaagaatgattttctttactgatcctcagcagctgtgttccgggtgtctttgttcaataaaggtagagataataactgtcagtggaaagaaaatgtgctgaggttcccaggagaagtggtggaaacaaatcttttattaaatcatatcaaattgtgtttctcgtttactttttccattttgtaagtcacagtcatatctgctagtttttcggaaaccttggctcacatttgtcaaaaaaacttggcttggcattcttgaggttaatgctgcgtgatcaatcggtgataaatttgacataattaactgttgtaatggcatttctgagtctgtttctcttctttactcctgctgaaatcatctgagattagttaacttctgaatatttcttcagatgtgctgtggatgcctagaaaaagagtggtaaggaagtgtcgttgatatctggagttcttatctgtccacaggttaatgatctctctgaataataacacccctatttccctaggaggatcccttcccctactctcaaggcaggtggctcagatgggcctgatttattcctggtgctaggggtgggcaaaagacccagacctgaccaatcaaaaacatcaaattgggccaaccagaacgaattagaattctgggacctttgctacaactattggaaaagataattttttttttgattggaattcctgaaagaacaagacataaacctgcttctggttatctttgctttccggggaaaggttttttttaatgtttatttttattttttctgagacagggtctcactctgtcacccaggctggagtgctgtagtgcaatcatggctcacggcaacctcggactcctaggctgcagagatcctcctgccttagccccctgagtgctggagctacaggtatgtgctaccatgcctggctaactaaatttttttttccttttttgagacagggtcttgctctgtcacctaggctggagtacaggggtatgatcgtagctcactgctccctcaacctcccatactcaagctatcctccctcgtcagcctctcaagcagttgggaccacaggcatgtgacaccatgcccagctatttttttttttaattttctctagagatggggtctcactatgttagccagtctaatctcaaacttttgggctcaactgatcctcccacttaagcctcccaaagtgttggcattacaggcgtgagccaccatgcctggccaaaaaagggcattcttgaagtcaaacaagggaaaacactgagaaatgaagggaggttcctgatcatgtcacttggataccagtgtttagccatgcctgaagtcttacccttcaattaggcaggctaatacattttcattttttgcctgagtccgtttaacttgggtttctggcacttacctcgaagaaagtcctaaatacttatgttttccaagtttcagtaaagtctcatgtatgggagagtgtggtcagcgccagcaatacccatgtccataataaaatatcagtcctctccccgtctgttattgctggtcaccactgtataatagactgtgttcaggctggagtgacagctccagtccacagttcatcagagggtctcagcccagtctcgtcaaggattctcatttctagcattcatcatggttgccctatatccatgctctgaggatatggcatttacctctgctgtgccttgtcctccccctaccttgtaccagtagatcagtagatccttatgaatgcacaaatacctctctctgcaccagagagagtccagcctgaggtttgtaggcagctagctactggaattttctcccagctttgtatctctaagatctcaggtccatttctttttcttttcttttcttttctttttctttttttttcctttttcttttcttttctttctttcttcttttttttttttttttgagacagagtttcgctcttgttgcccagactggagtgagtgcaatggtgcgattgtggctcaccgcaacctctgcctccctggttcaagcaattctccttccgcagcctcccgagtagctgggattacaggcatgcgccaccacgcctggctaactgtatatttttagtggagacggggttactccatgttggtcaggctggtcttaaactcccaacctcaggtgatccccccacctcggtctcccaaagtgttgggattacaggtgtgagccaccgttcccggcatctcaggtccatttctaggtcttgccttgccttacttgaattaggtaatgaccttatatgtgggggaagagatgatgtggacagggatatatggtctaacattcacagtgctcctactgcttatcagatactgtgcttggttcatttgtgtcatattatgttgtgttttccataacacgtaaggcattccatgtgcaagacactgtgttaagtgccttatcaagcaacatctaatttaatccttataaaaacaatagaaaggcattattatctccatatagaagctgaggctctaggttattttctttgtatcatacaatgaggaaatggcaaaagcaagatttcaactagggtctcaatgactctgaacccagttttcttacctccgacattagcacttactgtattttttttttttccaacttttattttacattcaaagggtacatgtgcaggtttgttacatgggtaaattgcatgttgcagaggtttggtgcacagataattgtgccacacagataattggcataatacccgataggtagtttttcaagcttcacccttttcccaccctcctccctcaagcaggtcccagtgtctattgttcgtttctttatgttcacgtgtactcaatgtctggctctcacttattagttagaatatgcgatattaaggccaggtgcggtggctcatgcctgtaatcccggcactttgggaggccgaggcaggcagataacctgaggtcgggagttcgagaccagcctggccaacatggtgaaaccctgtctctacaaaatataaaaattagctgggcgtggtggcaggtgcctgtaatcccagctactccagaggctgaggcaggagaattgcttaaacccaggaggtggaggttgcagtgagccgagatcgtgccactgcactccagcctgggcatcagagcgagactctgtctcaaaaaaaaaaaaaaaaaaaaaaaaaaccaagcatgtagtatttcattttttgttcctgtgttaattggcttaggagaatggcctccagctccatctatgttgctgcaaaggatacgattttattctttttttattgctgtgtagtattccatggtgtatatgtgccacattttctttatccagtccactgttgatgggcatctaggctgattctatgtctctgctattgtgactagttcacttactgtattgtctcattgatgagcatctacgtgtctctgctattgtgagcagcgcacttgctggattgtcctgttgataggcatctaggttgagtctgtgtctctgctatggtgagtagtgtacttacagtattgtcttgttggtctgtgcatccctctcacctgtgagcttcctgatctcgtgcactctgtgttatgtctggatcccgatcttcactttagaaccttgcatagagcaggttctcaaaaactgtttacagaattaaagaatctttatagcaatgtcagaaggtgagtattttctttccgttttacacatgagcaaatttaggcttaagaaagttaagcaaattacccaaggccaggaagtagaattcatgaaatataatccagaaatttccaagagaattgagaaagatattctctaagctaaagaggagggtttttgttatttttcggcattctaatataggtagtttatgtggaaacatggaagtaatttaccacctttcttaatgaaggccctactaggctgggctatcatgaagaaaacagcacagacatttttatgaaagaaaactacatctatgttactgcatctgtatttgagctccttataacatgtaagcaggcagaacattgtttaatgttgctggacaaagctcaagtgaaaatgatccagtggggaaatcttttatggaaattaaactgattgttttggaatgtaagttgcaatttttcacttcttagtttctgctctcttgagtccttgtctatgtcatgaacacatttgatacggaatcctggggactttgcccattgtaaggagcactgtagtggaaggcagtcgagctcaatgtatagagagaggcagcaaggtgggtaagtagaggcagcacctgggacccagctagatggactggtatctctaaagagtgcctcaaggaaacacatttcctggagcacttcagaacatgagagctgaggccaggatctggtgcagctcactctatctgaaagcactgagattctgttaagctaatgatgagttttctcttcatctttcctcccaacaccaagaccaagcaaaaatgcaagggaacaaagaacaagaagcagtgtccaaagtcttcagagtctctaggatagttgttgacctaagtcacactgctgtcatcctctgggctgcttgtacttttggagtagtcactggcagattaataagtttcctgaaagttaacagaaaataccagcttaaagtagtactaaagttttcaaaaaatttttttggggggaggatgagagggtgaaatatgatagtcaccctgatgtactcatggaagcatctaggttgtgttattagttaaaattcccagccatgaagacaagaatacatggaattcacccatgtgttcacccaacctcccatccatccacctatccatccatttgtcatccatccattcatccattcttccatccatctatccattaatacatctgtccgtctacctactcatctgtccatccgtccatccatccacctactcatctatctattgtccatccattcatccatccacttacccatctatccaccatccatacacccacctatccatccacccatccatctactcaccaatctatctaccatccatctatcaattatccatccacccacccatccatctacttagcaatctatccaccatccatacacttcacccatccatcaattcacccatcaatccatttacccattcacccacccaccatccatccatctatccatctatccaccatccattcatcaatttaccctatatccaccattcatatacctactctttgatccatccacctaccaatctatccattcatccatccacacacccacctattcatctatccatccatctacccatctgcttaacattaaccaagcatacataatgtgccaggcattgtctagggctaccaacacttggttcttaggaaattccaagactgcatttttttgctataaaataattttggaagtcaaatttgcctgaggagttttgttaaagtgaagcaaaatgtaatatgagtttatatagattttggctcttacataactatacttggcattgaaaactacgcaacttattcaggaataggtggtgtatggtacaagttgctgtatcatgcaaaaagatgggctgcaagaaacagtttttgtttaggctttgtttttcattaaaatctgtgaaattgttgagctcaagttgttgttttgcttggtcaggtgttgctagtcagctaaaaataagtctgtatcagtgatcgtcttagattctaagaaaactcagatgtgagggaaattaatgtgcttgcactttttgttacatgacaccatgttgaacatgcgtagagttttgtgaacagaggtggtagagcgtgttggtaagagttgcatagttggtaaaagagttttaaaatgtgtttctgattaatttacataaataatttggggccaaaaaccttctttccctccactcaacaccatatttttgaaatcccttcatgttgctctatataaatctagttaatttctgattgtgtcctaaagtcaacgtatgcataaaacacaatttgcttatccattccttgagtggttattgtataggaacatcaaagtctgtgtcgtcacaagcaaaactatggtggacatcctaatgcatgtgttgttatggccttgtgcaaatttctctagtgcacgtatatatccagatatgggattgttgggtagatgaatagttaattgcactgagtactgagaaattgttacttagaatggctgcttggtttacactttttactagcacttgatgttctctggcgttgtaatttttaccaatctgatggctgtaaagtggcatatcattgttgttttgatttgcttttctctgattattactgatgttgagtatctcttcatatacttattagccattagtgtttcctcttctattaattttattttcgtaggctttgcccatttttttctattgggtttcctgaaattttcttgctattttcaggagtttctctcaatattaatgccagtttcattttacacactgaaaatatcttctcacagtctaccaacgtgttaaacgtgtagatgatgtccttttctgagtagaaacctcaattgtaatcttgtcaaacacttcatcttttcccgttatggcttgttcttttaagtcttgctcaagaacctgctcaattctaaagtcacaaagatatttcccacattttgtttgattacttttatgatttacctttcacattcagatgtaaaggaaaaaatccaatttaatccttgtcatacagtaaaccatcctcccccaaacctaccaagttatttattctttcccaactgggttaagacaccatgtctcctatgtatgtggggatgtttctggaatctctatactgcttcaatgatctatttagctgttcctaagactgtagcacagttttttattattatactttaagttctggggtatatgcgcagaatgtgcaggtttgttacataggtatacacgtgtcatggtggtttgctgcacccatcagcctgtcgtctaaattaggtatttctcctaatgctatccctcccctagccccactgacaggccctggtgtgtgatgttcccctccctgtgtccatgtgttctcattgttcaactcccacttatgagcgagaacatgcggtgtttggctttctgttcttgtgttagtttgcagagaatgatggtttccagcttcatccatgtccctgcaaaggacatgaactcatctttttttatggccacatagtattccatggtgtacatgtgccaaattttctttatccagtttatcattgatggcatttgggttggttccaagtctttgctattgtgaacagtgctgcaataaacatatgtgtgcgtgtgtctttatagtagaatgacttataattctttgggtatatccccagtaataggattgctgggtcaaatggtatttctagttctagatccttgaggagttgccacactgtcttccacaatggttgaactaatttacactcccaccaacagtgtaaaagtgttgctatttctccacatcctctctagcatctgttgtttgctgactttttaatcgccattctaactggcatgagatggtatctcattgtggttttgatttgcatttctctgatgaccagtgatgatgagcattttttcatatgtttcttggccacatacatgccttcttttgagaagagtctgttcatatccttcgcctactttttgatggggttgtttgtgtttttcttgtaaatttgtttaagttcttcctagattctggatattagcccttcatcagatggatagattgcaaaattgtctcccattctgtaggttgcctgttcactctgatgatagtttcttttgctgtgcataaactctttagtttaattagatcccatttgtcaattttggcttttttttgccattgcttttggtgttttagtcatgaagtctttgcccatgcctatgtcctgaatggtattgcttaggttttcttctagggtttttatggttttaggtcttatgttaaagtctctaatctatcttgagttaatttttgtataaggtgtaaggaagggatccagtttcagccttctgcgtacagtagccagttatctcaacgccatttataaaatagggaatcctttccccattgcttttgtcagatttgtcaaagatcagatggttgtagatgtgtggtgttatttctgaggcctctgttctgttccattggtctatatatctgttttggtaccagtaccatgctgttttggttactgtagcgttgtagtataatttgaagtcaggtagcatgatgcctccagctttgtacttttgcttaggattgtcttggctctgcaggctcttttttggttccatatgaaatttaaagtagtttttttccaattccgtgaagaaagtcaatggtagcttgatggggatagcaatgaatctatccattactttgggcagtatggccatttccacaatactgtttctttctatccatgagcatggaatgtttttccatttgtttgtgtcctgtcttatttcgttgagcagtggttagtagttctccttgaagaggtccttcatatcccttgtaagttggattcctaggtattttattctctttgtagcaattgtgaatgggagttcactcatgatttggctctctgtttgtctgtacttggtgtataggaatgcttgtgatttttgcacattggttttgtatcctaagactttgttgaagttgcttatcagcttaaggagattttgggctgagatgatggatggggttttctaaatatacaatcatgtcatttgcaaacagacaatttgacttcctcttttcctaattgaataccctttatttctttctcttgcctgattgccctggccagaactttcaacactatgttgaataggagtggtgagagaggacatccttgtcttgtgccggttttcaaagggaatgcttccagtttttgcccattcagtatgatagtggctgtgggcttgtcataaatagctcttatgattctgagatacgttccattagtacctagtttattgacagtttttagcatgaaggggtgttgaattttgtcaaaggccttttctgcatctattgagataatcatgggatttttgtcactggttctgcttatgtgatggattatgtttatcaatttgcctgtgttgaaccagctttgcatccccgggatgaagccagcttgatcatggtggataagctttttgatgtgctgctggatttggtttcccagtattttattgaggatctttgcatcgatgttcatcagggatattgacgtgaaattttctttccttgttgtctctgtcaggtttttatatcaggatgatgctggcctcataaacgagatgggaggattccctctttttctattgtttgcaatagtttcagaaggaatggtaccagctcctctttatacctctggtagaatttggctgtgaatccatctggtcctggacttttttttggttggtaggctagaaattactgtctcaattttggaacctgtgattggtctattcagagattcaacttcttcctggtttagtctttggagggtatatgtatccaggaatttatccattttgttctagattttctagtttatttgcgtagaggtgtttatagtattatctgatggtagtttgtatttctgttggagcggtggtgctatcccctttatcattttttattgtgtctatttgatttttctctcttttctgtattagtctggctaatggtctagtttgttgatcttttaaaaaatcccgctcctggattcattgattttttttttttttgaagggtttttcgtgtctctctctccttcaggtctgctctgatcttagttatttattgtcttctgctagcttttgaatgtgtttgcccttgcttctctagttcttttaatagtgacattagggtgttgattttagatctttcctgctttctcttgtgggcatttagtgctataaatttcgctttaaacactgctttaaatgtgtcccagagattctggtacgttatgtgtttgttctcattggtttcaaagaacatctttatttctgccttaatttcgttatttacccagtagtcatttaggagcaggttgttcagtttccatgtagttgcgtggttttgactgagtttcttaatcctgagatctaatttgattacactgtgatctgagagactgtttgttttctgttcttttgcatttgctgaggaatgttttacttccaattatgtggtcaatttgagaataaatgtgatgtggtgctgagaagaatttatattctgttgatttgtggtggagagttctctagatgtctattaggtctgcttggtccagagctgagctcaagtcctggatatccttgttaatcttctgtctcattgatctgtctaatattgacagtggggtgataaagtctcctactattattttgtgggagtctaagtctctttatagatctgtaagaacttgctttatgaatctgggtgctcctgtattgggtgcatatatatttaggatagttagcttttcttgttgcgttgatccctttaccattatgtaatggccttctttgtctcttttgatctctgttggtttaaagtctgttttatcagagacaaggattgtaactcctgctttttatttttgctttccatttgattggtaagtattcctccatccctttattttgagcctatgtgtgtctttgcacatgagatgggtctcctgaatacagcacaccaatgggttttgactctttatccaatttgccagtctgtgtcttttaattggggcattttgcccgttcacatttaaggttaatgttgttatatgtgaatttgatcccgcctttatgatgctagctggttattttgcccattaggtgatggagtttcttcatagtggcaatggtctttacaatttggtatgtttttgcagtggctggtaccggttgttcctttccatgtttactgcttctttcgggaggtgttgtaaggcaggcctggtggtgacaaaatctctcagcatttgcttgtctgtaaaggattttatttctcctttgcttacgaaacttagtttaactggatatgaaattctgggttgaaaattcttttctttaagaatgttgcatattggcccccactctcttctggcttgtagggtttctgccaagagatctgctgtttgtctgatgggcttccctttgtgggtaactcgacctttctgtctggctgcccttaacattttttccttcttttcaaccttggcgaatctgacaattatgtgtcttggggttgctcttctcgaggagtatctttgtggtgttctttgtatttcctgaattgaatgttggcctgtcctgctaggttggggaagttctcctggataatatcctgaagaatgttttccaagttggttccattctccccatcacttttaggtacaccaatcaaatgtagatttggtcttttcacatagtctcatatttctcggaggctttcttcatttcttttcattcctttttctctaatcttgccttctcgctttatctcattaagttgatcttcaatatctgatatcctttcttccacttgatcaactcagctattgatcctttgaggagaagagatgttctggtttttggaattttcggtctttttatgctggtttctccccattcatggatttatttacctttggtctttgatgttggtgactttcagatggggtctctgagtagacatcctttttgttgatgttgatactattcctttctgtttgttagttttccttctaacagtcaggaccctctgctgcaggtatactggagtttgctggaggtccactccaaaccctgtttgcctgggtatcagcagcagaggctgcagaacagcaaagattgttgcctattccttcctctggaaacttcctactagaggggcacccaccaggtggcagccagagctctcctgcatgaggtgtcttttggctcctactgggaggtgtctcccagtcaggatatgtgggtgtcagggaacaacttgagggggcagtctgacccttatcagagcccagatgctgtgctgggagatccactgctctcttcagagccatcaggccaggacgtttaagtctgctgaagctgtacccatagctgccccttctcccaggtgctctgtcccagggagatgggggttttatctgtaagtccttgactggggctgctgccttttttttcagagatgcccttcccagagaggaggaatctagagagagagtctggccacagtggccttgcttagctgcggtgggttctgcccagttcaagcttcccagcagctttgtttacactgtgagggtaaaaccgcctactcaatcctcagcaatggtggacgccccttcccccaccaagctcgagcattgcaccttgagctcagactgctgtgctggcagtgagaatttcaagccagtggaccttagcttcctgggctccgtgtaccagtttttgaaattattatggcttagtaataggtcatggtatttagtataatgaatccttctccaatttttcaaaactaccttagatattcatgctttttatatttttacatacattttaatatttgtcaaagtcctcaaattgtgctggaatcttcattttttattttttattatactttaagttctagggtacatgtgcacaacctcctggtgtgccgtttgctaaggccgttagaaaagcgcagtattagggtgggagtgtcccaaatttccaggtaccatctgtcacaacttccctttgctaggaaagggagttccccgaccccttgtgcttcccgggtgaggcgatgccccaccctgctccatgggctgcacccactgtctgacaagccccagtgagatgaacccggtaccccagttggaaatgcagaaatcacctgtcttctgcatcactcacgcggggagctgcagactggagctgttcgtatacggccatcttggaacctcccccactggaatctcgattggaactgcattaaatccatggattaatgttgggagaaattaatattcttacaatgttaagttatcctattcatgagtacggtgtttgtcttaacttattgaggttttttaaaatgttctttataagagctttacttttctccatgaagttctagtgcattcatttttaggttaatttcttgatatgttatatatataacagagtgtttaaaaaatgatctaactatatatatgtaaacatgatagcaactacatatagttatataactataactatatatagttacatgactataactatatatagttatataactataactagttacataactataactatataactgtatatagttatataactaactatatgtctgactatatgaatatgtaaaaataggtgtatatatatataatcctaacaatatagttatatctatatatctataactacatatctatatatctgtaactacatatctatctatagatatataactacatctaactatatatagttatgtaattatatatctaagtataaaatcatatatagttatataactacatgtaactatatagttttatatatatatagatatagcaactatatctatatataactacatatatagatatagttgttatcatgttttaagcactctgttccatgcctggtatgtagtgagtacttaataaatggtacttactcttatttttgtaactattataagtgggggaaaagcaaagagggatactctccaaatgtctttaggagtcgtcatgatatgctggaaataacatggttgtggaatcattctcatgtgggttctggtctgtctccaccattaactgtgtcactttgaacacatttctcaaacttatacaatgggaatgatgcttatcctactggtgttctaggtatggtgagaagataaaatgagatcacaaactagtaatgaatactatgattggcacacaaaagcactcagaatgcaggtccttttcttctctagtgaagatctgataagtttgtcaaacagcaacaccattcccccacaaaatactcttttcttcatttgaagtccatttccaaaatttgtcctttcagatggatacagagagcaggtacacagattaagaaaaattgaaaaatttatccttccaagcatccccttttcaaagacacctttggtttttcatctttagaatgtaaactccttgaggacaggaagtgccaggaactccacacatccattcctgtcctgtggtttacccatgccagtcatggtaagcccatcacccttgtcagtgattggctcagggatgggttaagcccatgccagtctgggccagtgagattctaggaggaacttgatgaccgcttctggagaaggacatccagttttcctctttgacatccagttttcctctttgactgtatgtgagttaaagaggcccatgccccagtttctgctggcagtcaccttatatcagtgagggaagccagccttaagatgaagcccacattgtggaaatagagacagggtgccatgagcagagaaattctgggtttctgatgtcagcattgagctgctgaatcaatcaatgaagacaccttcccctttcaatgctctattatcataaataatgctctttttgatttagtcagttgtttttttttgttgttgttgttttttgagacagagtcttgctctgtcacccaggcttgagtgcagtggtgtcatcatagctgactgcaactttcaactcttgggctcaagcgatcctcctgcctcagcctcctgagtgactgggactacaggcatgagtcaccatgcctgggcaatttttaatttttattttgtagagacaggagtctcattctgttgcccaggctggtctggcattactgatcttaagcaatcctcctgcctcagcctcctgaagcattgggattcctagcatgaaccactgtgcctagccagtttagttagttcgagtaagaatgtcttttatttgcactctaaaacatcatagtggattcagacctaaagtctttgtcctgagcctgcaaataattgaggcttaagaaatgtatgatagtgaacacgaacgtgggaattatactggctttgtagagtgtagtgcattgcataatactgtgttctgtagattctttgagcttcctaatggccttttaatacagaatgcaattccttttcctctttagtgaagatacggatttactctcatctgtctctttcaggtgaggtaactgaggatcaaagagggtttgtgatatgctgaaatttgaatagatagctaagcagtccagttgtgataagaacctaagtcttttcactccttctttggtacattttctcatatgctcaatccccactaggctgtgagagccttaagggtgaaagctacaatcttacatatttttgtcaccagaatgcctagcagacagcctgtttcttttgggtcacaagtaatagaagaataaacacataaatgacttgttatatcttgaaagcagctttcatgtaaaggcagagggaatgatacctccttccaaagtgttttaacaatgtccagtggtgacaatgtcccatttcaaaggcaatagtcctgggtgtgttttgtccttggtatatctgtagatccagccttttagcacaggtataacaggcaatgatgccattgcaaaggctgtactgactagtgaattctttcagacacagaggaggaaggagtcaaacagcaaagtcagaagaggtagtttagagctgtcatcccgggtgctcctgggaggaatttgcacttaacacgtaaatcaggttcagggtctgtctaattaatacaacgactttagtgccatttgcttccccgtcagaattcatactgaattctgacacatggtcattgggtttatcaataatgtgccccataaatccagttagcattttcttctgggtgccgcaccttgggaagctgcttaaataccttgaaggtccttatctagctctggccttgaatctcaagaagggtcagaggcccttcaagctcttcactgagtatgacattactgctgtgatttgagtcctttgtgcctggctggaagatgttctggtgaaagatcttaaagcttagatgaggaggttacctcccaccaggctttggcattcttagaaggagtcctggtgctggggggagtgtctagatttgtcactggttgtttctgtttgctcagcatcacttcctttggtgaactgcccctcacctgtgcaacatgactctataggcctgccatctatgaaactctaccccaggctgcagagctgggtctgtaactcaatctggtcaatccaagcgctctctctcctgggaatctgattcttgagctgagacacacaagggtggaggtgatttatgcaaagccacttacttctgaggctgttcatgagtctctactttcaaactccccttcatttctatgaccttccaaatatcccttcaataaatatttagttcttgtttgcatgtgttagggtaggtttctgttacttgcttttaaatacctttaagttatacagatgtagatagtacatgatagtttattatttttgtttcccaaaatgaaaatacgtttgttgaatgttctagtaatggtggtgctattatcttcttcttattaatatcttattaatatatatcatatattattatataatatatattatatataataatataatattaatatataatatataatgtataataatatataatatataatgtataataatatataatatataatgtataataatatataatatataatatataatatataataatatataatatataatatataataatatataatatataatatataataatatataatatataatatataataatatataatatataataatatataatatataatatataatatatatagtataatatataatatataataatatataatatataatatataataatatatatagtatatataatatataataatatataatatataatatataatatataatatataacaatatataatataatatataatatataataatatataatatataataatatataatatataatataataccataccaaatgtgtatggtaatacatacaccatacactaaatgtgtatttaccatacaccataatatataatatataatatatataatatataatatatattatataatatatataatttatatattatatattatataatatataaattatatatattatataatatataatatatgttatataatatatgttatataatatataatatatgttatataacatatatattatatattatatatattatatattatattaataagatatatattgtggttatatataatatatattatatataaccacatttggtgtatggtaaatactcaatacatgtcaggccctgattgttacatgttttggctaaaaaagaaatgtggtttcattgagctgatataacttgcttaagagaaaacagctggccaggtgtgatggctcacgcctgtaatcccagcactttgggaggccaaggtgggtggatcacttgaggtgaggattttgagaacagcctggccaacatggtgaaaccctgcctctactaaaaacacaaaaattagccaggcgtggtggtgtgcacctataatcccagctactcctgaggctacggcaggagaattgcttgaacccaggaagcggaggttgcagagagctgagatcacgtcactgtattccagtctgggtgacagagcgagattgtctcaaaaaacaacaacaaaaaaagcaaacagctatgatacaatgggagctggtattaaataaaataatgcttgtgaagtgcccagcactgagcctggcacatatagcattctattctttatttattttattgtattttattttattttttgagaccgagtcttgctctgtcacccaggctggagtgcagtggcgcgatctcggctcactgcaacctctgcctcccggagccattctcctgcctcagcttcctgagtggctgggattacaggtgcccgccaccacgcccggctaattttttgtatttttagtagagacggggtttcactatgttggccaggctggtctcgaactcctgacctcgtgatctgcccacctcagcctcccaaagtgttgggagtacaggtgtgagccaccgtgcctggtctagaatgatctttaaattgcagctgctgttattcttttaagcggctcattagcccacatttgggagggaggtgtgtagaaacaatgccgcaggaaaaactcagatcagttagtcagtctccccttcctctgctatcgcctcatatgtcttccttttcctcccccttccagagtccctatcaggccccattccagataatccctgctgctctgctaagtgataactgagctattagctggtgtttaagataaagcctttcctaaaccatttgcatttcagtggggaaattcctgagaacctagtggctccctcattcaaagcatttagggggcattgctttctcctctagggagaccgtgaagatgtctctttggaagagttactcatccgtgctgaggtctcactaattaacatcttgcctcaggagggccagtgtgcctgaacaatgctttctactgatcagttctatagtgggttaccacaggcactgtatgattgccacagtagggggaaccatcgtcaagggcagatccttatggaattggaatattgcaatataggggtatttgtgtatgtgtgtgtgtgtaataaataatttagtcccaggtagtgccattcagtatattaacacatattatttatttctgttttcacagcagtcctaaaagttccgtattatttccccactttgcagatgaagaaattgaggccctttagtgggtattggggctctgctgttttccctcatccaacattctccttcccccttcttttgttattagcatatagctcacagtatagttgggatttgtgttcctgcccaaatctcatattgaaacgtaatccccgatgttggaggtgggacctggtgggaggtgattggaacatgagggcaggtgtcacatgatggtttagcaccatcgcgttggtgctgtcctcacaatagtgagttcttgtgagatttagttgtttaagtgtgtagtacctcccccttcttctcttgctcctcctttccccatgtgaccttcaagatccctctctgccctccgccatgattggaagtttcctgaggcctctccagaagtagatgctggtgttatgcttcctgtactacctggagaactgtgagccaattaaacttctattcttataaattacacagtctcaggtatttttttttaaatatagcaatgtgaggatggactaatacagctgatgtgggaccgatcctccctgctcttgtgtctgagaactgactaatctaaataatctacaccactggccactgggattggttcaggagtagacatatgaggccactgagagccagacttgggacttttgtaggagatgtaggaatgtgccttttctgacttagtggggctaagaaagcagaatgagcctagaggagacaggggcagtctttgcctacgtgagaataaaaccaacaccaaggaaacagaggtggaaaaagaaagcgtggtttcagttgttacaacatgaacatctgaatccagacgtgcccaacgctagaatattcctgggcttttcggtttgttgatccacacatcctgtttcatgcttaatccaatctttgatctgggtattctgtcacttgtaactgaaagaatcttcatgaagacagactcggagtgttaaggaatcaatgttagtgtccctgaaaaactcatacgttgaagccctagcccccagtgtgatggtttttggaggtggggcttttcagcagtaattaggttaagatgatatcatgagggtaaggcccaaacaatgagattagtgtccttataggaagaggaagagaccagagctttctctctacaccacgtgaggacacagtgataaggcagctgtctgtaagacaggaagagagccctcactaggctcactttggcaccttgatctcagattgtcagcctccataactgagaaatcagtgtctaatgtttaagccatacagtttatggtattttgttatggcatcttgaattgactaagagaggataagtgcctcgtgtaatgtcacacaactaataagcagcagagctgggatttgaactcaggtgttgctgacttccaagtccatgaagtctccacggaaatatgagctctggtggcaaaagaacggatggagcagatgccaacattagtttcagcctggagaagaaaacctggtgatatggtttggctgtgcccccacccaaatctcaacttgaactgtatctcccagaattcctatgtgttgtgggagggacccagggaaaggtaattgaatcatggggacccatctttcccttgctattctcatgatagggaataagtctcacaagatctgatggttttatcaggggtttctgcttttgcatcttccccattttctcttgccaccatcatataagaagtacctttcacctcctgccatgattctgaggccttcccagccaggtgccactgtaagtccagttaaacctttttttcttaccagtcttgggtatgtctttatcagccgcatgaaaatggactaatacacctgggcttgcaaggggtttggtagtgggctcggggcagctaggttacctggaaaggaaagagacggcctttgaaatacaacctaattcacttcaccactttacttagttgagtgttgcttgaacttctgttgctaaactaactaaaaattgctgttttttagtgcttaccagatgggaagcactgtactaatatctttgcaaacatcatctcgttcagtcatccaaatcaccctaggaaagagataccattatctctttttgaatgactttgccagagttacacagacagtcagtggcggagctgggatgaaactgtttaggactgagtcgtgttcccccaaaattcatatgttaaaaccctaacccccaatgtaactgtatttgaagagattaccttcatagacttaatcaacgttaaatgatgccattatggtggggccctaatccagtaggactggtgactttccaagaagaggaggagacacccgagttctctctctttccttgcacacacaaagaaaaggtcatacactcagcaagaaggcagacatccgcaagggaggaagagagatcacattagaaacttaattttccagcaccttgatcttgcacttcttgcctctagaactgtgaaaaaattaatttctgttgtttaagccactcaagttgtggaattttattatggcattccaagtagactaacacagaacccaagcctacctgggttcaaatctcatcttcttaaccaccacatgggattgctaacatccacctacccatgcacaaaaatttaacatatgaaaagatctttacagagcgtggcctgggggtggggctgcttcttcaaaagggctagaattggtcctggagtcctaaagctagaaggataagtgcaaagtcatatctacttggcagaatgaatccaaacctttcagcaggtgcaaactaatgttttcagctctgccatcctttctgtcgtatgggctagaatataaaacagctcagcctcatcaagagagtacaatgaaactctttgctgggaaaaggatagctttatttctgttaaagggccacattgagagcctcagaagcaactctccttgcaggacaaaggaaaaatattagagtgatgaattagttccttacaacccaatgacagactggtggataaatgcagtgacagaccccaaattttatctttctgcaagtctgccccaaataaaaagcccttatccttatagacactctctgaaaatgggattaaaacatagcagaatgccccactgtctgggtgacatttgttattattattgctgttaagtaagagccagggtttaggtgttaaaacccaagtgtgcggtaattacggtaccactgaggctcagcacaatatgcttcctgtgtctctcttgttttgatagctggctatattggcaagaggcatataccactggggctcaataaggtttagggctgtcctgttctgactaactccctttgtggcccaaataacactataaaaatcaacatgggaaaccttccttttttttctcctaagaaacgcctgcacaaaagccttatttttctgccttgaaagtgtttttaacttaaacgccaatttaattctggaaattgtctgtggagggccaagtgcattattatactctctgttatgatgaggataggaggatgcaggaggtgccatcagtggttatgacatctacatctttgaatcaggggttgtcaacactggtcatacatcggaatcaacttgggagcattagaaaagtactgatgcttgggtcctaaccgagatattttgattttcttggtcctggggtgcaggctgaccaatgggattttatttaaagtgtcctgggttattctgatgtgcagccgtactggagatccacttctttaaaccagttttagagttcagcattttccccataaacagcttaaagtataggaagtaaatggtatatgctatggtttggatgtgtttgttgttgttgtttgtttgttttttgagacggggtctccatctgtcacctaggctggagtgcaatggcgcgatctcggctcactgcaacttcggcctgccgggttcaagtgattctccagcctcagcctcctgagtagctgggattacaggcatgcaacacacacctggacaatttttgtaattttagtagagacagagtttcaccatgttggccaggctagtctcgaactcctgacctcatgtgatccatcttcctcggcctcctaaagtgctgggattacagcggtaagccactgcacctagcctgggtgtattttttttccccctgaaactcatgttgaaatttgattcccagtgtagaggtattgggaggtggggcctagtggaaagcatttgggtcatggggtggatccttcatgcatggcttggtgctggtactgcgatagtgggtgggggctggctttggtgagactggattagttcccttgagtgtggattgttataaagcaaggacacccctcatgttttccctctttgcacgtgtctgtttcctttttcaccttctgccatattgtgttgtggtgcaaaagccctcaccagaaacagatgccggcaccatgcttctttaacttcccagcctgcagagctgtgagccaaaacaacctttttactttataaattccccagcttcaggtattctgttacagcaacaaaacatgaattaagacagtgtctgtgctgtgtagataaatgtactgtgtgacttttgacaaattacttgacctctttatgtttcctcaattttctcgcctatacaattttggtaaaagaaatgcctaattcataagtttgtggtgagggttattaaatgaagtaattaatgtgcctggcagagaatacacatttgataaatgttggctattattattactgctattgttactatcacctgttagatgataaaccagaaactagtaaactagaaactagttttatttaaaaaaaggagggggctatttactgattcatgtaaacaaatctacgaaggggtaagggtagatctggtctcaggacaactgggtccatggactcaaaaccatccattgtttcttgctgtttctcattttgcttccttctctcatgttagcttcaggcttggggaccagcttttctgcataggaagaagaggcattatatcagactgacctggcacacattttatgtccagaaaggaaaaagggattttctcaccaggttctgctggggaaaaagacctgaggaaagattgtccagaattgagtcatatactcattagtgatctgtccactgtggctatggaggtgggatcttctcccagagggaggaaaagtgaggtgcctagaagacaaaaataacaaccgctacaatgatgaaaaaccagttctaataagaatgactatcccttccacaaatatttattaagcatctaacaggagccagacatggttctatatactactttataagatgagaaatggacattccattaaaaaaataccgaagtatagtttcgtacagtaaacttcacccattttttgagatataattcacatacagtaaaattcgaccttttaaagacatgtaatattttatcctttttggtgctatagtagaggtagtaaattttggaattgggaagtgttaggccttcaactttctttttttttttttttttgtaaaatttgacaaataatcatgtttcactaccacaattaagatatagaatatttcaattatcccttaaattgtcttgtgtgtctttgaagtccacccctttgtcttctccctgcctatggcaaccattgatctgtttttttgccactctagtttgccttttgcagaatgtcatttaaaaggaatcatacagcatgtggcctcctttcacttagcatttgagattcatacaaatcgttgtgtatatggatagcttcttcctttttattactgagtagtagtccatggtataggtatgctgctgtttgtttatccattcaccagctaaaggatatttaggttgtttccaagtttggagtgattgtgaaaaagctgccagaagacttgcatacaaaattttgtgtaaacatacattttaatgtcatttggtaaatgtctgggagtgaggatgctgaatcatatggtaagtgtatgctaggctctataagaaattgccaaaatgttaaagtggctgtgacattttgcattcccattcacatgcatgagagttatggttactttaccttcttaacaacatacgatattgtcagtttttaaggagggcattctgataggtgagtagtggtgtttcattctggttttattaataactaatggtgctgagcttctttttgggtgctaatttgcaattcatctgctttcttcggtaatgtgtgtgttcaaattgtgtgtccattttttgagttgcttgtttcttattattgaaatttaagtgtcctttgtatattctgtatataagtccagatatcaggtatgtattttgaatacattttttcccagtctgtggcttgccttttcattctgttaacaatgtcttttgaagagcagaaattttacattttggcctagtcaaattgatcaatttttaaaaattcatgaattatgtgtcgtatctaaaacacctttgcttaatccaagattagagagattttctccacttttttctagaaatgttataattttaggtctatatttgggtctatgatcccttttgatgtaattattgcagattatgtgatgtataggttgaagctcattattttgcttatggatgctgctgtgatttgaatgtgtcccccagagttcatgtgttgaaagctaaatccctaatgcaacagtgttgagagatgggaacttaaaagatcattaagaggctaggtgtagtggctcacacctgtaatcccagtgctttgagaagcccaggtggtgaatagcttgaggctggaagttcaagatcccatctcgacaaagcaaagcaaaacaaaacaaaacaaaaattgccaggcagggtggtatactcctgcagtcttagctattcaggaagctgaagtaagaggatctcttgagcccaggaattttaggctgcagggagctgcaattgcatcaccacactccaaactgggtgacagagtgagaccctgtctctaaagaaaaaaaaaaaaacaaaaaacgtgatcaggtcatgtgggctctgctctcatgaatggactaatgctgtcattgtgagagtgggtttgttattgtgggagtgggttcctgataaaagggtgggtttagccccctttcctcccctttttgtgcctgctcttttgtccttctgccttcggccacaggatgatgcagcaggaaggcactgccagatgtaggccccttcatcttagacttcccagcttccagaactgtgagaaataagccttgtttttaaataaactactcagtctcaggtattctgttacagcagcataaaacagactatgaaagatgttcaataattatttcagtataattgaattgcttttgcacctttgtgaaaaataagctgaccatatttgtgtgggtctatttctgaactctattctgttccattgatctatgggtttttttcttcatctatactatgtagtcctaattacggtagctttatagccaatcctgaaatcatgtagtatgagttcttcaacgttgttcatctttttcagaattatttttgaattctatttctgttgcctttctatttaaaatttagaatcagattgttggtttctacaaaaaaaaacttactgagggtttgatggaattgcattgaattagggagaattggcaacttaacaatattgaatatttcagtccatgaacacataataggtttctatttaggtcatctttaatttcttttatcagtctttgtagttttcaccacacagatcttgcacatatttttttctaaacgtttcatgtcttttgatgctatggtaaatgtaaattcaaaattagaaatataggtcctccagctttctttttttcaaagccgttttgtctgtttctggattctttgcttttttacatacattttagtattagctttctggaaaaagcctgctgagatttttataggagtggtcttgaatctatagatcaacttgagaagaattgctaaaaataatattgagtctttcaatccatgaacatgggatatctatcaatttatttaggtccttttacatttttgtcagtaatttttgtagttttcagtgtacaagtcttgcacttcttttgttaaatttattcctattttattccttttgatgctgttgtgaacagaattgtcttcttaatttcattttcagattgttcattactgatatatagaatacaattgatttttgtgtattgattttctatttcttcttgagtgtgctttggaagcttatgtttttcaagtgatttgtctaagtggttgaatttattggcataaagtcgttcataatattctcttgttctatcttaatgtctgcattatctatagtggtgtcatctcttaaattcttgcttttgataatctgtttcctctcattaatcagtctggctaacggcttattaaaattattgattttttaaattatactttaagttctgggatacaagtgcagaatgtgcaggtttgttacaaaggtatacacatgccatggtggtttgctgcacccatcaacccatcatctacattaggtatttctcctaatgctatccctcccccagccccccaacccctgacaggccccattgtgtgatgttcccctccctgtgtccatgtgttccccttgttcaactcccacttacaagtgagaacatgcagtgtttggttttctgttcctgtgttagtttactgacaatgatggtttccattactgggtatatacccaaaggattataaatcattctgtaaagacacatgcacacatatgtttattgcagcacaattcacaatagcaaagacttggaaccaacccaaatgcccatcaatgataaactagataaagaaaatgtggcacatatacaccatggaatactatgtagctgtaaaaaaggatgagttcatgtcctttgcagggacatggatgaagctggaaaattgatcttttaatgcaccattttttttctcaagtgtttttctcttttcaactttattgttctactcttatctttattatttactttctttcgcctgacttggattttatttcttttactttttttttctagttttttaaggtggaggcttaggctacgatttgagacctttcttattttcagacataagtatttaatgatacagaattccctgtaaacattgtttatctgtgttccacaaaccttgatatgtcaaaatttcttttttattaaattcaaaatatttcctaattttcattgtacctccctatttaatccacgggttgtttagaactatgttacttaatttgcaagtattttgatattttctagatatgtttatattattggtttgtaatttaatctcacatggttgcagaatatactttgtattatttcagtattttaaatttgttaaagttgttttatggcccagaatatcttgctgaatggttcatgtgaacttgaatagaatgtgtattctgttgttgttgagtggaacattctgtaaatgtcaattagataaagttggttcatagtgttgtatatccttgctgattttctatttcttctgtcaattactaagagacaaactgtgaagtctccaagtgcaaatgtctatttttttagttccataacttttttgcctcatgtgtcttgaagctcttgtattaagtacatatgtattttcaatggttatgtctttttggtgaattgattcctttatcattatataaagtccctttggtaatatttcttgttctgatgtctactttgatactaatataaccactccagatttcattttgttgtgttttaaaactattattttaaataaatacatggttttggatagcatttccatggtatttgtagtttcattcttttacttttaatgtatttatatctttatatttaaagtaggttccgtgtaggcagcctatagttgggtcttgctttttaaaattcaatctgtcaatctctgtcttttaatgtgtatttagaccatttacatttattatcattattaatgttgggttaaaatacaacatcttattagttgggaattattattgatgtgctttctttttgttacatctgaatcttctgtgattctccaaatggtctctgctgagctgtggcaaacagaggggaagaggttattccattctgaagagtgccagtgccagtggggtctctagtagaggtcagctatgcccagcctatggcactgccacctagatctcaagcagcagaaacagcaatgtggcagactgacaaaatggccagttattcaacaaatcccttgatgagtactgtctcattaacatggtagatacaatcattataccaccagtgtacagatgagaaaattgaagctcagagagactaagtgatctgaccaagattatgcagtggcagagctaagatttgagcccaggtccatctgaatttgaagtttaacatcttattcactatgtggacaggctatagatacataatttgaaggcatacgttaatgatcttaatccaaattgttatcaatatgtaagttgaaggatgtaattacattttcaacctcgtgaggggtttgtgccttcaaggtaagataacacaaacctgttacctgttggatattatctatttaaagtggctatttttaaaaagatgaaagataacacatgctagtgaggatgtggagacattgagacccttgtatgctgttggtgggaatataaattagtacagccattatagaaaccagaatggagtttccacagaaaaattaaaaatggaactaccatatgatctagcaatctccctactgggtatatacccaaaggaaatgaaatcagtatgttgaagagatatctgcactctcatgttcattgcagcattattcacaacagccaagatacagaatcaacctaagtatccattaacagataactagataaaggaaaggtggttatgtatacacaatggaatactactcaaccttaaagaagaaaatgctgccatttggaacaacataggtgaatctggaggacattatgttaagtgatagaagccaggcacagaaagtcaaataaaacatgatcttacttatatatggaatcttaaaaagtagaatttatagaagcagaaagtagaatggtagttacacggggatgactgttggggagatgttggccaaaggaaacaaagtctcaagaggaatgagttaaagagatatattatacaatatggtgactgtagttaataacaatatattctattcttaaaaattgctaagagattagattttaagtgttctcactacagaaaataataagtatgtgaggtaatgcatatgataattagctcaatttagccattccagtgtgtacatatttcagaacatcatcttgtacatcataaatgtatacagttttatttgtcaatgaaaagttaactaattaaaattaaaaaaactggtattatttgcctttattagaaatccagtaattactgggagacaaggaaacataatcgagttgaagactcaatcaatttgtactgatgaattggccaagggacatttctgctaatttgcccatttcttgggtttgtagaaaagcagggtacagacgatcgcttcagtggagaaagaagctctctaaatgaagatagcaagtggtgaagcagagtgattctgacatctgctaactagataagtacaccgactccaccagctcattgctgtgctttcattctaccctgtggaatcccttttagccaatccttgatcaaataatgaacctattgcagaaataaaggggaagcacgtccatcactacctccctaactcagaaaaatcaagcttttttctgttctacactgtttcctgtcatgcgtaatatagcaaattaattagtggatctggcggcatttgctaatacaattcctctcccttgcttgaggtgaattatgttcatgcttcagtcacttgaatattactcttccatgtttgacggaattttgttatcaggtgactatattgcacactatctgattctaattaaaccagaaaatagtgacattgtacaagaggagaatgtttcacagtgtgcaccacccacccccttgtcgctacatcccagtttttagagctttttgagctgtgcttgggctattttcttatgtttacatcgtcttacgcttctccagacacaatggcttcttgggcattgccttcatctactaggtaatttgtataaattgagtcctggaagacataatgtttacacttgtctttttttttaatcagaagcataatgcacagtagcaaactgtgagtatttcagatgatatgaaagaagaaaatgtgctgttttgccaaaatcattcatgtaacttggaaagaaaagtttctgagagaagaaaaactaacattttagaggggaaacggagaaatgggctataaagatgaattggggaagcaatgtaatgtagaggttaagatcacaggcttgtagtgcagggcttgacttctggttctgtctttatctgacactatttctttctccttacacaataataagtgctcaggagttgatttgccgaaggtctaatgatgaggtagtaaaagaaccagggctggggctcccattccagttttcctttttttctataccctgttaaatgccaagccctgattctgccagggtggagagtgaaggggagtctctggagtcatcaattacagcaggtcactgggtatcagagtctcttttctcatgaggataaagatgtccttttgagttagactatattcacccttcatgaaccttggggacattgatggcagggagagttttctaaagctttagacaactcagaggtgaaataggcaccatgctgcaaatgaaaggcacttttatggttgtctgaaaaaaatacagcacactgctttaaacttagaaagcccaagtgcaagctacagtcaggtgtggtctgcaggctttggtcttttgtccctgttcaacagctggtaaagctgggagaggtaatcgctgatggagacttgctcctgttgggataatatttctcagaccatagtcctgccattttccagactttttcttttggagaaatgggctcctaccttggaagagccaattatgtaattcaggttgaacctggctcttttttttcccactgatctctatcttccttggtgaagaccacttggcctccgcctccctgttagatattattcttggcctatgtaagcagtggaaagcctgaattttgcccaggctttgggcaagatgaaatgacaccttctgggttggtggaaggaaagggctatttctttgggctacttgaaggacccagaaagcaaaagaaaaatcatgtctttctttgcagaatttctgctgtggaaagaggcaaagtcaatcaagagacagagatccttgacacatatgtattgaatatctactatattgcaggtcatattctgggtgctggggagatatctgaacaaaacagacaaaaatccctgccatgaggaacaaggaataggtgtttaatatggtctgtagaaaaagtacgggaataaaagtcccaaacctggcctttttactagtttatagtctagtggggagaaatagacttaagaaacaacaaaaagaggaacgtatatagtatattggaaggtgataagtttaatgaagtaaattaagcaaaggaaatagatagcaaaagcagagaagaaatggaggaggtttctatttaaaacagggaggtcagagaaggctttctgcaacagaagaattttgagcaaagacttgaagaggcaagagagtgaaccatgtagatatctgtgggaagaacattacgggaagcaaactcagcaagtggagaattcccagtatgttttaggaagagcaacaaggccaagtgtggtgggactagagagagagagcgagtacgggagagtggtgagaaatgaggtcgtcttcaatgattgtagtttgcttaacttgtggctgctggctagacaggatgaagtagtttgagttgtttaagaaggacttactaggtatgtgggatcagactagtgctaggctagaccccaggacaggaaagatgactgcattcaaggaccaagtagttcagttcaagattgaatattggcctgtatggaaacttagaaaacagtgaggctcaggtgtgttatatatagatatctgaaagaagagagaaggttgtagaggactggattggatataaggctctggaggcagactgcctgggtatgaatcgtagctccattacttattactggtgtgatcttgggaaaaccacttcaccgtctgaggatcagtgtttacatctataaaatggagttcacaatggaaggtacattgcaggggtgtgtgaggatttaagacagcacatgtttagcaagtgccatgtacatagtaagccctcagtaaatatgagctgacattcttattattcattgaggtggttagagaaggattctgtaaagcttgaaaccatggagttagtgatgtgccatggactgaactcaagggaatttctactagactgcccttaacttctcttagatggtgcttggatagattgcatgtgactgaaatagttttttggtgctggaagcatcataaggagataggaccagcggattagaaataaaggggtgatggttgtgcctttaccaacagtgtgttgctatggagaagaaggccctcaaggaaaaagaggaaaatgtgatcaaatacatcagcatggggttgaacaagagcagtgaggacaatgttcatagttgactgactagagtagtgtcaataagaatggcaatttattgagcatttgcacatgtcatctcacgtagggcttaccgtagtcctataaggtgggtactcatattatctttgttttgccacagaggaagtgaaggcttacagaagtgaagtgatatgctaaaggtcacacagctagtaagaggcatatctgggactcagctcaagggagtttccattagactgcccttaacttctcttagatggtgcttatatggcttgcatgtgactgaagtagatttttggtgctaggggcatcataaagagagaggtctagcagattggaaacaaagggataatggttgtgcctttactaacagtgcattgagctatgctcatttatgttcttatgatctcttagaaacagagacttggttctttcctgtcttaagaaggaaaatctgactgcggggtatggccatcccctaaaatatcaaaaagacatctatttccattttcttcctcctaatacctaggagacaacaaagtggatttccagtggtacttcccacatgagtagaatgaactttccttggtaaaagttgactttcttactaaaggacaaaatatataggctcctcaatttgagccatgggatttggtgggcagctggactgagcccaaagacatccccacagggaggcaaaactggctggtatatgtggaaagagtgagtggctcagggaatagatgctgtgagccaggttgtgaatttccagagcccagggattagagccacttgacattcactttaggtgaactgtgttgtcttacatcctatttttcatgaatacttttaaaatttttatttttttcttttaatttttttgacacagagtctctttctgtcactcaggctggagtgtggtggtgctgtctccactcactacaacctctgcctcctgggctcaagggattcttgtgcctcagtctgctgagcatctgggactacaggcatgcaccaccatggccagctatttttttttttttttgtatttttagtacagactgggttttactgtgttggccaggctggtctcgaactcctggcctcaagtgatctgcccaccttggcctcccaaagtgctgagattacaggtgtgagccaccatgcccagtctttcgtgaatacttttgatgtatggagtaactcataaatttttaaaaaatatttcaaattcctaactcttcttgaaacaataggtattatgggtggctagtttatttcttttcagttaatgattgaattcattgagcccttactaggtggtgagcactgtccgaggtgctgaaggaagagacaaagataggattactgtatctcagaagcttatattttagagaacaacaaagtaccatgtacattttaccatgtaagtttagcctgttatatatgaaaatgactttttacctaaaagtaatgagcacaagtcatgggttttaaaggtaacttgttcaattctgacattatactcttggtcaacccaattggtgaatcagtatttccttcaatagtcctgggataatgaagagttggcaaacatgttacataaaaatttaggaattaagaatattggactcttcctgaagataggatattttaaatgcaggactagagctcctgaaccatatattatagggaaaatctagagaaaaaataaaaggtatttatcaatgtttggttgtgtgatcttgggtagcttcttgtgcctcattgtttttgtcatttagaaaatgatagaattaatctgtacattgataatgaagtccctttaggttctagaattctgtaattttggtcttgaactgaaattaccatgacaagggattttgatagatgttgcctaattgctaaccaatgaaatgttttctacaactccacccctgctcttttggcattttatctttgttaagtgaaaaatgatatgtgttgctttgaactttattgctttaatttgttgcagaagttgagtggcttttcatatatattaaatttgattggttactttatttaaaaaattgtaaattgtatgattttggtatccaggtaagatactgtgaaagttaccttgtaattaagttcttgggtgatttattggaggccttaatattattataatagataatagggctgtctaaatgccactgtacttggttatcaagctcaatgccatttaaatttttttcaaaaaattttcaatgacattcttgttattgttaacagtttacttttttcccgtgattgaaaagactaacactcaagtttgaaagagaaatgttaattttcagggctgctgcaaaccttgaatttgaatcctaatcttgccacttactgcttgtgtgaccttcagcaaagtgctcaatttatagaacctcagtttaatcatctgtatattgggaataatagcaaaatctgcctcagagattattgataggattagctgaaataatgcatgcaaaatgcttagtttattgcctgaaaacttattaagtataataaatatttattattgtaatcaacagttgtactagagagctattgcacaataattatgattataatgaaaatgataattaataagacccccacagtttctgatttagaatgtgtctggggaagagcctgaggatgtgtctttctaacacattttggggtgatgctgatgctggtggtccaggcaccatgcttggagaactactgttctaagcatctgaacaatgtgatctcatttggtccttaccagatcactctaggaggcaggttcttttatgatggtgctttaataagtgagggattagggaggtttagtagctttcccaaagccccgcagcttggaagtggtggaaccaagagttaaagatttatgctcttctttccacctgtgattatttatgtggagttctaaaccattgatctcctgtatccacccccttgatgtcttctctcaccacctttcccgactctaagccattgccaattactatcaccatccccttgtccacactcgtgattcctgtgtccctctcttgcgttgtttgcttggcatggtcacaatcccggttaaattcatctctctgcctactctgtacctgcccttgagaaactgaacacggctggagaaacatacaaaactactccgaccttgccaggaacctcgaatgacccgttaacactgccaggagatcacactgcactttcctagcccattcattctgcatcttgctttttcgtttctttaaaaatttattttattgtggtgagaatgtttaacccaagatctaccctcttaggaactgtctaggtgtacaatacagcattgttaatgattggcacaaagttcagcagatctctagaacgtatttgtcctgcatgattgagactttattggttagcagcttcctctttcccccttcctccagcccctggcaactaccattctacttaatgtctctatgcatttgactactctaatttcctgccataaacaatatgatatatctgcacctacactcatgcaatatttgtctttttgtgactggcttatttcactaagcaaaatatccttatgattcatccatattggatattgcagaatttccttgtttttatttatttatttattttttgagatggagtctcactctgtcgcccaggctggagtgcagtggcgcgatctcagctcactgcaacctccgcctcccgggttcacgccattctcctgcctcagcctcctgagtagctgggactacaggtgcccaccactatgcccagctaattttttttttttgagacggagtctcgctctgtcgcccaggctggagtgcagtggcgcgatctcggctcactgcaagctccgcctcccgggttcacgccattctcctgcctcagcctcccgagtagctgggactacaggcgccagctaccacgcccggctaattttttgtatttttagtagagacggggtttcaccgtgttagccaggatggtctcgatctcctgacctcgtgatccgcccgcctcggcctcccaaagttaattttttatatttttagtagagatggggtttcactgtgctagccaggatggtctcgatctcctgaccttgtgatccatccacctcggcctcccaaagtgcggggattacaagcttgagccactgcacctggccatttgtttttaagtgtatgtatataccacattttctttatccattcatacatcaggggacatttaggttgtctccacatcttggctattgcgagtagggctgcagtatacattggagtgttaatatctctttgagatcctgatttcaattcttttggataaatactcaatagtgggattactggattgtatggtagctcaaattttttgagggagaaggaatctccataatgttttctatagcatctctcactttcttcaacacctattttacatgtctcttttcttctcaaaccccatctccttcccattcttactctcagctgatgaccatgtttctttgctctttcagagaaataaaggaaccagaagggaattcacactgactcccataatctcatctccccacattctggcatctgtactcacccactccaacctctcacctgtgcccataggtggaaggagggaaggaggttcacagtgagtgtctggagagctggcgatgttctgtttcttgagttgggttctggtagtataagaatatccagattacaattccttgagctgagtacttataattcatgcacttttctgtgtgcatgttatttgtcaataagtccaaaggcaaaaaaaaaaaacagataaactcattaaagtttaggatgaaacagggataagacttatttgcctttgaaatactagttctcaaccaaaggagatcctcatccctgtccctccccaccaagggggcatgtggcaatttctggagacatttttggttgtcgcaactagggagaaggtactcctggcatctagtttgtagaggtcagtgatgctgctaaacatcctacagtgcacagaatagtccctacaataaagaattatgcagccccaaatgccaatagtactgagattgagaaacttggccgcaaaagaacctgtctgagaaactccaggatcacttgaacattaatttcatccaccatagtctttgctgatattgagctccttatttactagattcagagaatgtatcctttcccaggggagcatctgagagcaggagcgaatttcatttgctacctcgtaaatctctgaaatggaaaacaggtctgaatattcctctgtctctctctctcccctagtctttgaagccctccaaagtgggccatggcagttagctcacaacaaattccccagacacaatttaaatgtcattttgggggctgggactagggcatgaatatttaagatgtaaattgtttgggctgtgcctaaatcttttatgggttttactggatgagaaaaatgagttactactttttgatgaagttcactttcctttcatattattagcaaacccagccaagtgaaccagactgcatctgccagagaaaatagggatgcttgtttgcgggatgatattagattatgttcccagcatgccgtatttatggttcaaaaatcaaagaacaggtaggagagttgtcttaggtcagcgtgtccttgccagtgaaagtagcttaccaaatacacttgggaggacagtttggaggagtggtggagagtagaagtgaatttaaatagtcgaactctacctgaagagttaggtaccctgagggttgattttagagaaatattgaaatcacgagatactaactccagagattagtcctttcttattcttcagtttaaatcccaggggatgggtacagagcagaggcaaaggaaaggacacacaacaaggaaaaacagagagagagagagagagagagagagagaaaaagagagattgattgatttaacaagttccatggacttcagaaagaatatatattttaatctttttggaagaaattatgcctcctacgtctcatttccaacccctacccagaaattaattttgaatgttaatatgaaagcaacctctctcttctctgaatgctgcttttgattctgacagggtatctaaaaggctgctattagacacattttcattaactaataagctggttcttgggcaaaacatgaattttttgtcatctcatgtgaaaattgtaaaaagctataattatgaagaaaatcactaattgtaaggcacaaaatttgtttgctaagaatagtcattaaggatcgacaaaagcattagtaacttcaatatcagaaaacaactattgaaatgcaagtggaatcaaggcatttgcccagacataataatggctttacgtttaaaggtctataattgtggtttgatctgagacattgttgggaattttcaagaaacaatacagagtagggctaaatacttaaagtaccgtggcttttggattccaaattacagactcgagttttaatttctagagaatattactgtagggagagttactcaatgatattgtcaatgctgttattgctttaggattgtgatgaagtggtcaaaaccaggacaaagaataatatttctgtggcccagacgttttatgatactggctttgcatgcaaagtacctggcagctggcagcaagtgaagtttgcacatcacttcatgatgtatgtcccttctaaagagtaacttttattgtttctgctttctgacaaatatcctctttgcagaaaattaggaaaatgcagaaaattgcaatgaagaaattttaagttctccttaattccatcaacaagagatagccagttaacattttggtgtattttcttctttttatttcgttttaaacttctgaagtataataatgtgataaagtacacaaaatttaagtatccaacttaaaatgaatttctatctatatctccatgtaaccaccacctagatgaagataacgaacatttccagtaaatttccttccttcatgctgttttctagtcagtactcacctctctgcctccctcgtagtacaaggtactattattctggttcttctcacaatagatttgatgatttttaaacttaatataaatggactcctacagaatatcctctgtaggtctggcttctctcactcaatattatatttgcaagattcacctagcttgcttcatatagctatagtctttttcattgatgtatagtatttcattatcttttatactattacttatccattgatgactgttgagttgttttcagtttttagctattatgaataaaaaacaaacattcttaaaaatgtcttttgtggattttcagtaatttcttttggattcctgtactttttcgtatgtgtgcatgtaaatgtgaattatacagaaggttgaatttacattatgtctctccatctccatctctatccctatctgcatctcaatctctatattcttattaatcacagtaattaaatgtcttctaggaaaccagtctgtcttgggatccctgccgtgcttggacattgactgggggcgatcttggggaaacaacatggtcctgcacatgctacataactatttacattctttagatgtatagactcttttctcttttaccaggccagcatgtctccagctgggttttcctgggatttagccatggttatcggcctggtatccaggagagaagttaagggaggcttttgaaggggttagctgttgccttgccaggtagaggcttctaaagcatctttcagcacagtggagctcctactagggaagagccagctacctgtacaaacccagagagtatggaggcagagcaggcagggcagtgttgcagaatctgtattctcagcagcatccatccagctgtctctgtctcatattttaaaatctcaagtttttcccactagaaccctgacctttaaataacaggcctaccttggttgagcactcaaacatctctgaagtgctgcaactataacaatcaggtcatcagtctgcctttcagctcactctgcccttccattagagaacacagtttgtttttttttctttttctttctttcttttttttttttttttttttgctagctaccacagaggctctctgggcctcgctttaccattaattgtttgataatagccttcagtctgtcagtatttttctgcagggcatcaataccactaggtagtaaccagccaactctcctgactttgaagcatggttggctccatattttccaattgcttatatcactacatttgatacagcatttcctcccactgggatattcttctatgtcccagcaaaatttttagcaaccgagccaccacctttggtcaaggactaaccatgttccatctaccagtcaggacaccatcttcacctgctgggcagtgggtgagccagtcttaaattcccatgttaccgcttgttttcttgcaccactgctggcctcgcttgtattagtcccagtcctctgagaagcagacagcaagacaaggtcaaatatgcatggatttcattatggaaaatgcctttgaaagaaaatggtgagggagctagagaaggttggaggagacatcagaccacagtgcaagtctgacccccaagtgaaggagagagggacaaatgttgggtggaagtgtcctagactgtcatgctgtgtaaggaaggttcacaagaccaccagggagttcttgaaccaaacttggctgttagaggagtctctcacttcccaggaaaggggcttgtcttggtattcctgctgttctcagacgttagttggatgcagtccatgggaagcatggcctctgtgcaaatgcaataatagattttcaggaagctcttgggattttggtcaattatactctctgtagctggaagtctatgagacgcatttttctggtcatcacaaataggatcagcacaatacctgtaagtctccatgttagcgacagttatgatttccttacatacttctacatttagggtgttgctgatttgtagtttgataaataatgctgctttgagcattgacataattcattgtttccttaggacagatgtttggaattagaatggtggggcaagaggatgtgaacattaacattcttgatacaaggttgcaaattgccttcctgaaaggcaagaccaattcaccatgccccccattccttatggaatacaaagtgcttgctttccttactcatatgaggtgcttctgtgttccggatatataagaggtcatgctgtgcaatgcagaggacaggtggaattcatgacacaagctggtgggaaagggaagacagaatgattatgggtacaatgtggaatgatttctatatgagcttagtttgactgagatggttagtttgggagagagagggtcatggatgacgtggacatagcagagggaaagctccaccttataacctcctcatgccatccatatgttggagaggtcttgtgtgtttcctataagaggcttcctggccaaaatgtcacactgtgagttctatggggaagcctatgaataccttgcctactgctgtgtttctgccacttggcatatataataaaacagatgtcctgtatttacatttgagttttagagaaagagagagcgcaacggttttctaggagcatatcgtatgagtgtcagtgcggagtagtgggaagtgctctgtatttacctggggttgaattctggttctgcaggagacctgctgaacctctgagtctccatttcatcagactcagtgtaaaatgtagtagcagatggaagtagaggcatttatcttcccttcctgcttcccccttctcccttccccttcccccttctccttccccttccccttcccccttcctctcccccttccccttccccttccccttccccttcccctccctctcactctcagctgcctgttttctattcccccttcctaagaaacccaatctgccttttgggggaattatctctccctaaaatgcagtcttagtggattaataatccatggttcctatcaaccttctggactagaccagggacaggcatgcgatctaggatatggaattttgcatagaaggatacagttacaagattccatggctgatgattcaatccagttgttgagggatgggggagaacttaggtgataataatgaacaatttcttctaccaggagcatctgtctgtttaaatcctagttcttcagtctccccactaatgagctccttttaataaattccttttctgttttagtcagttgctgttgattgcaaccaaagacccctaactgataaacatttatgctcaaggtttttgactttgtgctttttttttttttttttttttttttttttttttaaaaagaattcaatgaaaatgtctactagcttaatcagagtctaaaaaaactgggattggcaacggggagaatcttgatttccagttttcatctttttcttccattttacaacttctgccttcgtatcttttctagcaactgtcctgttcctccaaccgcaatttttaacttccaaaatgcttcataagcatggtgaaattatccatacttatatgctgtgctgtagaattcctttggagaacacacaatatgaattgaaaggagctgggaattaacttatcatctgttttgaagagatgtgtgggatgtggggcggagttttttgattgtggcttgaaaattgattctaattgctgtttttattgctggtttagctgatgctactttcagttatttacattttctgtctttttttatttttattttttagacagggtctcgcagtgttgccccagctggaatgcagtggtgtgatcacagctcactgcagccttgacctcctgggctcaagagatcctcccacctcagcctcctgagtaactgggactacaggtgcgtgccaccacacccggctaatttttgcattttttatagagacggggacctactgagttgcccagactggtttcaaactgttgggctcaagcgattagcctgccttatcctcccaaagtgctgggattaaaggtgtgagctaccacaactggctctatgtctttttaaaatgacttaggcaatggcatatttgactccaccccaaatatatttattcaaacattgaaaatatatctacatactcatgtggctgggcaatttagaagacaactcaaacccaacaattccagatatacttaaaatactgagactaaagtatcctctgatgagggtagtgcttgaatatctgaataattatcttaaatactgaacaattcagttacctctgagtacaaagatacatctatagtacagtggtttagggaattgactttggatttagatagaccttggtttaaaccctagctctgcttgttatagactgcattgtagggaaattagttttctcaacagtaaagggaataacaatgctattagcctaggcttatcctacttcattcttcagacctttattctgggatgctttccttaatatgtcaccctcaacctcagcccaggttggactcttgttatgcatgctcacaggactgtgtttattctcccagagacccggttacagcttgcatgggtacacttttttattagattatttgattacgtcttccccagctccctgtatcacactgcgctgtaagcaccgtgaggttagggacaaccatatctatctccttccccatttattctcagtgcctagctcctggttggcactcaataaatatttatggaatgactgaataaatggaaaaattctttcccataggggattcactgagacaatgaatataaagtacagtggctggtacatagtaacaactgagtaaatgtagtctcccccaaagaaaaactgcaaaaaaaaaaaaaaaaaatccaaacaacaaaatcccaaacaccctcaacaatcaaaccacatgtcatataagaaataaaatatttataggttgttgtcttcattaagatgctgacttttcagagtaagttatgctcttgaatcaaaccacagctgattttagtaatttaaaataagtttatttcttgctcatgtggcaatctgatgaaagtcaggttcatggtggccctatgactctcctaataagctaagtgggcctgaagggtctcccatcagcaattaagtgcttgaatttggaagtgatacaggtcatttctactcaaagcccattggtcagaattagtcatatgacctcttctagatacaagtcaggctagtctcctgtgtgtctaaaaggagaggggccaggcacagtatcttatgcctgtaatcccagtgctttgggaggccaaggtgggaaatcacttgagcccaggagttcaagaccagcctgagtgacaaagcaagaccctgtctctacaaaaaaaaaaaaaaaaaagaaaaaaaaaaaagaagctgggcacagtgacatgtacttgtagttccagctactctggaggttgaggtgggaggactgcttgagcccagaagtttgaggctgcaatgagctatgatcatatcatatccctgtattccagcctggatgacagagtaagacactgtctcaaaaaaaaaagaaaaaaaaagaaaaagaaaagaattggatatcagtcaacattagtaatgtctactgtaggctgttaaatgaagctaagcatacacttttctttaaaatgcagtgcctgggccagggtagaggttctataaatacttgttgatgaaatacaggcttgagtattctacatactaaatgctaacagacttaaacgaagtggctacgggtggaagtaatattcatggtcaaaatttacaatgctagactgtgccaggaggtctttctgcttggatggtttacgggctaaggtgaagggtctcagtgccaaactgaagaggccaaagagcataccaggggttggtcccttagagaaagaagacaaaggttctttcttctttcctcctgttccttggagatggatgagatgtgcttttggctggcatgttagtatcctagtaccacaaccttgggtaagccaaataaagttatttcttcacaattttggaggccagaagtccaaggtcaaggcgtcagcagggttggttccttctgagggccatgagggaaaggtctgttcccagcttccctctttgacttgtaggtggccgtcttcccccatgccctcacgtcatcatctctctgtttgtttgtgtccaaatttcctcttgttatcaagacaccagtcggccgggtgtggtggctcatgcctgtaatcccagcactttgggaggctgaggcaggtggatcacttgaggtcaggaatttgaggccacctggccaacacggtgaaaccctgtctctactaagaaacaaaaaacaacaacaacaaaaaaacaccaggtatagtgctgtgtgcctataatcccagctacttgggaggctgaggcaggagaattgctcgagcctgggatgcagaggttgcagtgagctgagattgtgacactgaactccagcctgggcaacagggcaagactctgtctcaaaaacaacaacaacaacaacaaaaacaaacaaaaaaacactagtcatatcagattagggcccatcctaatgacatcataaaaataaccctgtaaagagcctatctctaaatatggttacattctgaggtactaaggattaagaattcaacatatgaatcttttgagggttagacacaagtcattccataacaactagtcaaattccaggatgttgcattgacctatagtgtttagggtcacagtctgcttctcttctggggtctcatctcttcagaattgttctcttgcttttgagtaaaataggcataataatagtatctacttcaaggtttgatatgaagattaaaagagttactacatttgaagtacttaaaatagcacctggcacagagcaagtacccactaagtattagcattactggaagtacttgttgtcattactttttcaaatcatgatcacttctattaggctggacaatctttctttatttgtctcctaataatattagctgctgcttactcagtacttgctgtgtgcccagcactgtgctaaaggctttatatgtatcacttcatttaatatgacagcaatgctaagagatcaaatctgttgttatcctgaaggtatagagtggtagaaacagggatgatactaaaaaaaaaaattttttttagaccaggcatggtgggtcatgcctgtagtaatcccagcactttgggaggctgaggcaggtggatctcttgaggcaaggagttcgagaccagtctggccaacgtggtgaaaccccatctctacaaaaatacaaaaattcgatggacatggtggtgcatgcctgtgattccagctacttgggaggctgaggcaggagaattgcttgaacccaggaggtggaggttgcagtgagccgagattgcaccactgcactccagtctgggtaacagagtgaaactcggtcttattttattttatttttttaacaaactgagaagcaatggcaatgaaaggtctaggacacccttggccctgccagatattaagagttagttcctaatccgtagggattagaaggagggcccagagtgatgggagtgactctgggagttcagggaaataactctaaccagtagaattatttcaacatgttaatagctgacgagactgtacagaggcatcctggttcattgtctgccctggagggacctgggggtgactgtcccagatccatgttcttaaatatttgctagcgataaggctagagagcctcattttacagacaagagattgagaaccagagaaggcaagagactttcatgaggtcacgcagcgagcaggttggtgaagtagcctgactcctgattcctaggtctctgtgtaaattaagttcctttttcctgcacctctcactgctagtcaagaagcagcagcccagctcatggagaacggcaaactgggatcccagtaggatcccaatgctgcagggctctgtctccctcttttgctcacctggctggggtgggtagactgagggcttggccacctctcaaactcttatgctgtctattctgacaatgatggcagagggaagtggccactgtctgggacagactggcctgggggttgagcccactcagcaggcagatcttcaggtgccttttccctcactgagcactccagcaggcccagatgccaggtagctgagtcggccctggatgtggtgaaagactcagaggcacatggggatgtaccagaccagagcactcacctgtcctctttcctgacctgaaagagagacacacagaggcaaatgagagaaagaccaagaggtaaagccaaagagacaaagagctacatagagaactgagcaacagagccagaggcagaaagacccagagatgcagagttaagacagatagtcagatggagctcaagagagatgaagaaggaacaacagaaaaacaccagcgaggatgacagggaaaagcaaagaaaggcagagtgaaagaaacaggaacagtaagagagggaggggtgttggcggggtgctgtggctcacacctgtaatcccagcactttgggaggatgagacgggtggatcacgaggtcaggagttcgagatcagcctggccaacatagggaaaccccatctctattaaaaatacaaaaattagctgggcatggtggcagatgcctgtagtctcagctactcgggaggctgaggcaggagaatcgcttgaacccaggaggcggaggttgtggtgagccgagatcacgccactgcactccagcctgggcaacagagtgagactctgtctcaaaaaaaaaaaaaaaaaagatggaggggtggagggagagaaagagaggaagagagagaggaggaggggagagagggggtagagggggagaaagagagggaggaagagaagcagagagagggggagagaggggtagagagacggagagggagaggaggaggatagaggaagagaaggagagaaagaagagagagagatgaagagagaagcaagagaagataaagggagagggaggaggtagagaagaggggagaggaagaggggagagagaaagaggaaaggagagacagaatgactgatacaggggtataggggtacaggagaggctggcaggtgatgtagccagtgatatggggagtagaaccgcaaagggcttgtgaagaagaaagaaaaattaggagaaaggccattggggcaggtggaagggaggaggactaggacacagagaagacttttcgtggcattcgtggctctgtttgttatgacaggggcagaaatacagactcagacacccacggcggcccattagtccccactgccccgccgctctgccagacggccgccccttctaggtctgttgcctctgagccttatttattgctccaaaatctgggaccatggggagtccctgctgggaagctcaggcggaagcttccatctaaatcctggactcggcttccagccactgcagctgaacaggagggacagtgggaggacagagcttgatttgtaccatggctttttcacacatggagggtggtgtcttttttctggaagcggtaagaagattctgtgctgtccctagggatgtaagtcttgaccttattcctttccactaaagaaacaatttaaaaatccaaagccaatttcctaataccactctgggcattttaaccagagttgaagctactgaaaatacagtagctaccatgctaggaatgttgtaaggatgatctcatttatccctgtataatgctatgaggaaggttctattatcttccacttttgcaggtgatctaacaggctcagggaggtgaagaaacttgcccaggattctgtttctgtatataccagagtctgacctgtctggctgtgtttcttagtcactgtgccatcctgcccccgcctcccaccaccattatacagatgaagacatcggggcttgtcaattttttttaatacaataattttattattttttaaaattagatatggagtcttactgtgtttgccaggttggtcttgagctcttggcctcacgcaatcctcccgcctcagcctcccaaagggctatgtttacaggtgtgagctaccatacctggctggttctttttgtttgtcttttaacttttatgtttaagtttgggagtacaagtgcaggtttgttacataggtgaacttgtgtcatgggtgtttcttgtactggttattcaccacccaggtattatgtctggtacccattagctatttttcctgatcctctccctcctcccattcctcatcctccccctcctcccattcctcatcctccaaaaggccccagtgtgtgtgatttccctctatgtgttatgtgttctcataattgagctgccatttgataagtaagaatatgcaggatttggctttctgttcctgtgttagtttgctaaggataatggcctccagctgcatctgtgtccctgcaaaggacatgataccgttcctttttatggctgcatagtattccatggtgtatgggtaccacattttctttatccagtctgtcattgatgggcacttaggtcaattccatgtctttgctattgtgaatagtgaggcttgtcagttctaatcatttgcccaaagtcacgtgggtagaaaggtgcagaatgaggatttaaacccagtagggaattagacctcagtaggtctgcttaatttcagtgcgtctgctcttatcccctatgcattggcttggggattttcagaaataggtactccctccaggtgcttcaggcaccggtttgttgtgcctcatgaagtaaagagagcaaaagctccaacagaactacacacttaaaaattgttgcagtagtgaattttatgttacaggtatcttaccataattggaggttaaaaaaattgtgtgtgtgggtctgctgaggtttgaaaaatttttgtaaacctccaattgtcgctgtctgtggagtatggttaatccattctcatctagtcgtcatgctattttcatgatgcagctttgcctacttgctgcactgacctccctttacctccagatcttcgttcctgcagattcacagcttctgtttccttgggtcttctgttgtattgtggccttctgtttcctgctttctctgagtgcctcactacttccaacattctctctctctctctctctcttagatggtgcaaaattaatcgcggtttctgccattaaaagtaatggcagaaaccgcgattaattttgcaccaacctaatggcagaaaccgcgattaattttgcaccaaccgaatatcttcatcaagtcaaccgtcctaggagaaaagatcagattgaatggcatcttaggttgggtttcctggaaacaggctctcaggtgtagatttgcctgcagggacttttttgagggagagcttttgggatcagcattatgggtggagtgcagacaatggtactgggaggcagagatgttggactttgacgcagtctcaacagaggcctcagccaataccatggggatgctttggagctggaattgtgttcagatttatccccttcaagcaagaggttcaggtcttaatatttctgacactggtctgttattagatatgagctgcccttagtggggggtatgactgcaggtgaggtggctttctttcactgagggtgattttcagagatggactgagctgacatctgttggctaccagtactcccaccagctaggggaatgtgagcctcagtcctgaggggaggtctgggtggtaccccacaacatcctctgctgatggaataatcccttttcagaatacagcagcccatgggaccacctccatggctcttggtcttccctgctccatccaatggatgtctgtatttgcctctgttgctaattcctggtgcaatcagatgcaacactggtttcaggtcctatgacatggaacatggaaaccatgtgcaggaatggcctggggctttgctcagatggggtggcagcacagcagagcctttgagcaccctggattcttgaccatagccatgatgccttgccagcttcccggagtccagaagagaattcctgtactccaaatttttcttacttaaggcctgctagcccagttgttaggagcacagatctgaaaatgttctgaagctgatctccaaatagcagaaccatttcttctctgctctacaaggaattcctcttgttatgtcacccgatctcaaagtattagacaccaaggaagtgtcccaagagtgtaggtggatcaatacatagtcacagcccctcctgaacaagagcaatccttctgctgttggccagactgccattcatgcttctcaaaccctctgaagtttccttgtgaacagttagttttttttctgcttagtctaggactttctttcctctctagcaattttcctccatgaagtgaaaacagacatggagacacatatgctacgggggctcaatatagcaccgtcagtcaaaccctgctctctccctgctgcagcaaggatatggctgggctcccatcctttccttccccttaattgatttccaaattcagcctcctaggatggtgccttggctggcattccaagttcagcctctcaaccttaatttaatgcttctagggtggtgagaacttatgtttcccacctactagttggcatctggctgattttcttatcctgaagaatttagtttcattaatgtcaaacctttgtacattgcatttgggctgtcaacagtgatgcatactcctgctgttcccagtcctcctgaaacagagtccttcacctactccaggacagtgttggcattcagggacccagttgtggcccatagcaagactgtcagccataggacttgcttcattcaacccaggagtcccagggcccgggctgggatagctggaggatgctaaaagcaggttggataattcagggtctgcttaattttgcccaggcagcctgatatgaggtcttgaagtcaagttttccagccttcttcttccaagattgtgccagaaattctatacttggagcaagttaacttttcagcactgagatggcaaatgtttatgattggattttcacactcctttctggacagaggacaatttttgttgtaaaatagaaacatagggataggaggacccaaggcaccttagtagggctggatcttggaagaatagtgatatgatgaaacaggttttgtcttctgtattttcttacccctattctttgtaacaaatattgattatttattgggagtaacccaaatccctttaggtatgccaaatatcccagatctcaccagcttcttggtataaatggggtcattttgagacaaatgtttagaccatacaggctcatagcttttgcctcttcctggtggaccccagtgttttcaggagtcctgcagagatgtctcacgtgtgctagaatatgtgctaactcttaggtttttttcactcaagacttttttgtttgtttgtttttgaaatgtgtctcctgcaaaccacttaaggatgacaactctctgctgtacttctgctgcagtcttccacaacatccctgattccctgccactctgatgggcgcatgggctcttttacaaatgtgccgtggtccgtgcattgtgctgctgttgtgcccctctgctgcaacggcaaggaagtccctttgccttgcgtacatggaacttgggtgccaggctcccaaagcagttcttcttgtgcccagaacctctcagccaagtgccagtttctcttctcccgtgaagactcaagccaacatagaccagtatagcttctcatgtctcaaagctcatgagaaatttacaaaaaggatcagtggacctctggatttttctgccttgtgctcaaagctcagaaggccctgcgttacatttaggaaggggaggcacaaggagaggatgtgccatgaagccactgctgaaaagcagacttagtggttcacactcaggcatgtccatcagtcaagctctccaagctgtgttttttagtgtgttgcataagccacacgtggtgtggagggaatggtgttagtttatgccaaatcaacagcagcaaaaataatgacatcatggacaataataaaatagtcaaccagcaacagatggaagggaagaattccagttatgctaagaaactgttagtgacacaaactgtttggagtcttagctggtcaaaccaaacccaattccactagccaaaaaataacaaaaatattatcattcagccagaaacatgagccactcaaatcccctgtccagaaaaacagtccttttgggatctgatggggcggaggggcaaagcaatttcaaagtatcaccctctgctcaccatcaaagagccttgtttgttcactgatgcccagtaaatcagaaccagggaatcagatacaaatttcctttgccttttgatttcctttattaatggaacctttttagaggtctgtttatacttttcacttgtacaaaatcacaatacttcacacaaaggcagcagatgataccgaaagctggagattgggcctaattgcctctctcgtaaccagtgctaacagagccttctcttggatgtaaggaaacttgaatctaattgcagggttggttgttccaattctgtgtaactataggtttctttgtctggggttttttcctcctcaaatttaatgtttctccttgagctcctgtcagatagctcctttaggaatctgagtagagtaaccgttgattattttaaactgagactgaattttaagattacaatgttccaggagtggcgtctctaagacttgaagtgcctctgtgtccacatatccccctggatcctcctgttgaggtttcatgtgaacctcatatttgtttcatatttggtgttatgtgagccttccacctggccataggtgattggacagggactggcacttgagctgaaagtagccaatgagttagcctcatgtaagagtccatctctacataggactatgattaattagacccattacgttctccttctgaaagttttgaatgagacgttgctcagagtgagtgggatatatgttcattctagtaggaatcttgtctgttttctttcctaatttatcaccattattgataatagtacccagcacttggctgggcatggtggcgcatgcctgtaatcccaggactttgggaggctgaggcaggcagatcacaaggtcaggagttcatgactagcctggcaacatggcgaaaccctgtctctactaaaaatacaaaaattagccaggcacggtggcacgtgcctataatcccagctacttgggaggctgaggcaggagaatcacttgaacctgggaggtggaggttgcagtgagccaagatcgcaccactgtactccagcctgggcaacagagcgagactctgtctcaaaaaaaaaaataataataataataataaagtagtacccagcatggcacacaataaatatttgataaataaatgcacgcacccttatgtagaaagatttttaaaaaatgaatcaacatctctctccccatattttacctttttctcctgccaccaggcagccaggttcttccttatctcctcttttaaattgttattattcttttaaacacactttattttttaaggcacctttaggtttgcagcagaactgagtggaagataatagagacttctcacatatcccctgctgcctcacatgcatagcctcccttattatcaacatccccacagaatggtacatttgttataattgataaatctacattgacacatcattatcatccaaagaccaagtttacattagggttcactcttgctgttgttcattcaatgggttttgacaaatgcttaatgacatgtatctaccattataacaacatacagagtagtttcactggcctaaaaatcctctgggatccaactgttcctctctccctccctcccctcaacctctggcaatccctgatcctttcactgtctccatcattttgatttttccagaatgtcatagagctggagtcatatagaacacagccttttcaggttggcttgttttgcttagtaatatgcatttaacattcctccatgctttttatgacttgatagctcatttctttttaatactgaataacattgaattctctggatgtacatagattatccattcacctactgaagggtgtcttggttgcttccaagttttggcaattatgaaggaagaggctataaacatctctgtgtgggtttttgtgtggatgttaagttttcaatccatttgagtaaatataccaaagagtgcaatttctggatcatattgtaagggtatgtgtagttttgtaagaaacctccaaagtgtcttccaaagtgcctgtaccattttgcattcctgttagcaatgaatgaaaattcctgttgctccgcatcctcaccagcatttggtgttttcagtgttttggattttggccattctaataggtgtgtagtgatgtgtcatgattgtctgaatttgcagcttcctaataacatatgatggtgagcatcttttcttatgcttatttgctatctgtatatctttgtgaggtgcctgttcaggtcttttgctcattttaaattgggttgtttgttgtcttatttttgagttttaaggattttttgcatattttagatgctagacctttatgagatatgtcttttgcaaatcttttctctcattctgtggcttatcttctcactcttgattctctctgcatttttctgactttttgcctgggcaaaaaagatgggcagtatggtacagtatttaagtgttcagattctggagccatctgcctgagtgtgagtcctgattttgccacttgttaagcaattgatcataccatctgattctcaattttctcatctgtgaaatggagagaatattactgccaccctatagagttgttatgagaagttagaatggtcccaacgtgtagttagtaagcactgtataaatggtagtcattatttttgggattatctcttttttgcgttgtttggactcagtcactaattggttcttgtcttctaccaatcctttctttactcacaccattgaaggcacactggcctctacccccacctcagggtgtctgtccttctgtttcctccttttgaagtgctttcctcccaatatacttgtgtcttgctctttcatctcgttgttcagtatttttagctgtcataaacagaagcagtctaaaggtgatggggtttcctatctttggtagaaatctctgtccattgatgctagctatctcagagggaagaggagctttgtaggagcagagagggaggaggagaggttccttgagactgagagggaaaggagtctgtatgttcagagagtgatggagactgagccttgctctctgggaatgttcctggaaggtggcaagatctcaagggaaagctgcccccaggaagactgggggacctgggtccgccaaggatctccaggccccaagcatgacctatacactgcagaaccacttggattgaagtcaccatgtagactgaagcagagtgtacactggtgacagccaagtggactgaggtttgggtagacactttctatttcctactgtgacatgaaactctatttactctgcatctgacagagtaactgaggctaaacttcatgcaagttcatagggatggtggctcaaagccagagggactttgactaatgcaatctgagtcatagcaccagaattatgttatcaaacaccagatgtttgcccaagatccagttgtttgctgcacagaaagccaatcatagagacaataagcattacaagggaagattttttaacatgggtgatgtcacccaggagacaggagagaaatcccaaatccatcaccccatctgactaaaatttggggtttatacagcagggaataaatgtaactacatgtgggaaaataggaactagggagggggtaaggaagagtcatagtcaacaggaactagtgtaggaaaatatgaattagggaggaattgatagcagttggttggttaggcaatcatgacagatgagtggtctggtgtctcattgcagtgacctggtaagtttcagtttcttgatactacctcatggtcagtttcctgagaaaggaactcagataaggtaaatggaagtttctcaagttttaagactgggtatgtcaatttctacatttatttaaagaaccataaatatcagttctatgggataattgggctggttttataaagaaagtgatatttctttcaccttgagtttggactttagaattatacacaaaataaatatttccaagttcatccttgctcactgtaatttgagagactctagttactggtaaggttaccatttagacacgttccagtcgttcttgtccctgtgtctttcccccctcaccctgccctttctaacctttcaggtattggaagtgagttcccttctgagaccacacttttgaattgctcatatacctgcttgtttactgtgacatccagttgtatgtgttgattacttcagcctccccgaccaaactataggatgaaccttgagcaagaaataaacttttgttttattttttttttaatctcacaagaatggctgaaatttgttgttttaaatgagtgacattaggtgtgtttgttgtcctaccctcaacaaccttatcctgagcgatacctacattaaatccttaaaaacactgtcgccaaactgttgaaaccaaaggaagtgttcaaaacattggaaatggcatatctttacagacaaaatattttgccttagcaaacatgtggagaaggaagtggatgttgctatatttagagcacaaagcaaatgtgttgttttggagtattcaggcagataaacatgttcaaaaacatgttcaaaatgttccacctattgcctggttagaaataccaatacagcataaaagttcacagtatttccttctacatgttgtatacacacacctatacaccgataccatatactgtagagctaagggctgtttggttgctagaaacagtaagtatttaattaaattcacagaagttagagatcaaactatggcaggatgaaggcaagacacacacctagctcttgtgactccgtatcatctcctgttcatttgagtctcgcatggttttgcaaaattataaagtgttttcagattctcttccttcatcacatttgatagaatgttcacagatttcgtgtatcaattccttgttgaattttcactgttttactatcatctgttttattccctcattctctttggttatatattttacccttctgaacagtttctcctaattatgatacaatttttagcttttgtatttttgttacctaatttcagaatctctaaaaaggatgaacttaggagttgagttggaagggaggtttgggctaaagggacatttccttacctaagaatgagaaaacatcagttgtccatatcaagggatgggagatttgctaatggagattatgggggaacaaactatttcccactccagaaccaaccttggcaccacaactgccataaacttcttttttttttttttttttttgagacaaggtcttgctctgctgctcagactggagtgcagtgggatgatcttggctcactgcaacttccacctccctcctcccaggttcaagggattctactgcctcagcctcctgagtagctgggattacaggtgtctgccagcacacccagctagtttttgtatttttaatagagatgggttttcaccatgtaggccaggctgtctcaaacacctgacctcaagtgatctgcccaccttggcttcccaaagtgctgggattacaggcctgagccattgtgctgggcccattgtgtggaatgtttattcttcttcttcttcttctttttttttttttttgagatagtttcgctttgttgtcaggctggtgtgcagtggcgtgatctcagcttactgcaacttctgcctcccgggttcaagcaattctcctgcctcagcctcccaagtagctgggactataggtgcactcgaccacacccagctaatttttgtatttttagtagagacagggtttcaccatgttggccaggatggtcttgatctcttgacctcgtgatctgcctgccttggcttcccaaagagcttggattacaggcgtgagccactgcgcccggccagaatgtttattctaaaggcaatgatttcctcaactttctactttgtcttcttttaaacaagactctcatacaatctcttttgaaatcactacaatcagggagaaaaattgtttgatgtctgaccagttaataatgagactctggacaaattgttcagctccttagatggacaataatcatatgacttcattgaattactatgaagattatataaaatcatatctgggaatggcttatggggtgagggcatatggggtgagaacccttacgtctgttctttccttgcagctaatggggaggtagtgtcactgaactaaagtaggtccctttgcctatgcaactgaaagccaaacaccaaagcaccagatttttgtagcaagaaaggtttattgccaggtggccaagcagagagacaaagtcatgctcaagtctgtctccctgtactggccttacagctgcagatttaggggagcgatgttaggggtggggttttagggctgggcagtgattggctgaaagggagggatgtttagaaagtcccttggacatgccatcgtctcttgacacttcttcatgagttgcatgtgcaaattcggagggagttggtatgaaacatgtgaaaattcgggctgtgacatcgaaagattactcattgggtgagcaagtttgttctgtgcaggctccagtcagccatattggttccaatctgtttcggtcagttttgtaagctaggggggactgtagcaaactgtatcttttttttttttttttttttttttgagacggagttttgctctgtcgcctgcccaggctggagtgcagtggcgccatcttggctcactgcaagctccacctcccgggttcaggccattctcctgcctcagcctcccgagtagctggaactacaggcgcctgccaccacgcctggctaattttttgtatttttagtagagacggggtttcaccgtgttagccaggatggtctcgatctgacttcctgatcctcctgccttggcctcccacagtactgggattacaggtgtgagccaccacgcccggccagcaaactgtatcttattcctgcaagataagctcaagatttctgttagtcaccggtttctttaaccctgtggggcatggtttcagcagcatgacctagtaggtgttcatgctctaaagtcacatagctgggttcaaatcctaaactctgcctcttgccagctttgtataaacaggatgtgggggtgcaaattacttcagttctcaaacctcacttgcagtgtctacaaaataaataaataaataaataaaatgaaatctgatacagtgtgaggattaaatgaaatattgagtctatagcacttggtattgtaagtgctatatactcaagaaatggcacgttttgttaacttcattagaaacaagtatctcttttcagtccagtcctgtgtcatcattgtcttcatcatcatcatcatcattgtcatctttgttttttagagatcggatctctttctctgtctcccaggctgaagtgcagtgctgtgatcataactcattgcagcctcgaactcctgggctcaagcgaatcctcctgcatcagcccttgagggttcaggactctcagcccttgaggtgctgggactgcagatgtgcaccttcatgcctagctaagtttttattttttagagatgaggtcttagttgtgcaggctggtcttgaaagtctgacctcaggcaatcctccagtctcctgaagagctgggattacgaagatgagccactgtacccagctttgtatcttctaatagaagctcgcaatccttgattggaaacccttggggacacatgttttaaaattcagaatgttatggaaattagaaaggtaatgtggagcataaactatacattccacaacatcccactttcagtggggtctgcagtagcacttcctggtcagctcattactgccgttaaatatgtggatgttcatgctaggtgggatgtgagataaataaaggacataaatagcctcatttcagttctggtcaagttttgttgccaaatgaatttgtgccaaccttaattttaaaaaatttggtttccagagcttttgggaattcagaaacccatgcagtcattaaaaattctcctgttctgtgtatttaagctatttctagtgcttgtttctgctttaagctgtgcttctcctacatctctgtgtttcagtcaacctttcaaagctttctttggactcagctctcctcctttgacttcctgtgttttacttacccctctcatctctgtctctattctttacccccttctggacttcttctccttcgggagttcacacactactggcatgaagactgttttcattttctttgttttttccctctgctacattgtctctagattctcatgcctctctctctcctcctctgtggatttcagagtcttgcttgtgcagtgagggctccctgcctctgttcttgtctaagtatcatctcccatttgatatacccttttatttctggtgaagatattttatttttcataaaaacatcattgtacaatgctctatagaggaagaaaatttcctttaatgtcccccaaatgctatgtggtttaacagtcatcttcctttaaaaaactgaatatgtaattgataataacaactgatttcttgtgaaatatagcatttatgttttaaaaatttatttgcctttattttaactaaaggcaagtccagtttaaacctgtactttttgcagttagccaaatcaaagctatcataattcaaagacaataaaataaagtgctaaatggtggtgctgattctttgtttctgccctttcattcattggtggtggcgcttggctcccaccctaacgaccttaccaccctctttctccttttaatttcttcatctcttccagatatacctctttgttcatgctttcttttacaatgccaatatcattatgataatttattgagctcttactgtgtactaagcactttacatggatcatttagtttcatcctttcagtactccatgaggcagggtaaggactctcttaatccttatatttcagatgagaaaattcaggctgagagataaagtgacttgctcaagattacacagctagtcagtagcagaaatggaattcaaacactattgcattaaatttttgcattaatccttgttgcattaaactgattccaaagcttatgatttcagtcactatgcctttatttcctccattgcagcagatactgccattcctgttattgaattcatcttctctttctcgatttttacagcgtcttaaatctgactcatctctgctgccctcttttcagcatgccattatcttaggtggtttgtccacatttacccatttccatggttgaattgttggtccttatcttttcccaatggcacattgagattattttataatcaccacatactcatggtggactataggaccaatcccaatttcaaatattcttgtcctcacaaaccactgaagcatcctggaaataagatgctggtcagcagaaagagcatctgcttcctctgttgctagacacctgcccattcaaagtcatgtcttggcagaaggcaccattcaaagtcatgtcttgacaaaatggcttcatgtcataaagccatggtatctgtgttacctttcgggtatccgtgaataattgaacctatgtttgttatattagttagacttgctgtgcagcagtaaaccaaattgccacatttctaatttaatgtaacaaagacatatgtctctttcacctcaaagtcagaggtggtttaggagtctccttggcttttctccttgaacagtgactcgactcagggatctgggatgtttccattgtgtaactccgtcttttttttttttttttttgagatagagtctcgctccattgcccaggctggagtgcagtggcgtgatctcggctcactgcaagctctgcctcttgggttcaagaaattctcctgcctcagcctcccaagtagctgggattacaggcgcccaccaccacgcccagctaggtgtttttttatttttttttatttttagtagagacagggttttgccatgttggccagcctggtcttgaacttctgacctcaggtgatccactcaccttggccttccagtgtgctgggattacaggtgtgacccaccacacccagcagcaactccatcatcttaaagttccttgcttccagccacctggataggagagtgggtgggacctattcacagacgcttacccacaaagaacagtcattatcatgactacaaagacatattcattgagatgatttgtccaaggtcttccaagttagtaagtggtagattcagaagtaactaccttgactcttttttccatgataagttttagtaactagggatattttatctgtgttaatccttcctggcttgatttatttaattcacaatgagttattggattttttttctttttttcttttctaataattctgccaaaagttccagggagggttcccttgggtaggcttgggccatatgtccatctatcctcaaaccaatcactctggccatgacaatatggcattctgtttggtcaggtcagtgttgtgcatctgattctagagaggaggaaatggattatggggcaccttcacctctaccatatgtggtgggaacagtggagagctgtctcccaaaataaagccaggatgctgttattaaaagaaaaagtagcagatgtcaggcagtcaaatcaagagaaggactatcaagttgaacaactgaatgaagaaggaaatataaaggagaattagtgactaaggaaattaatcaatgagaaaataaatgaacaaatgatgcttctttgatggcagatgagggaatcctcccaaatggggaaaagtgaattaaaggcaagctgatgccacactgaacataggttttgaatgttgcattgttttgtggtaggttcatcttggttaaggtgaatcttggagggtccagaaactttttggtacaaaaatgattatgtgttccctgtgcacctttgacttttctcaatctcactggagtgggagcagctttcagctgttgacctgctaccctctgtcttagtccaccttgtgttgctataatggaatatctgagattgggcaatttataaagaaaagatgattatttggcttatgatcctggtggctggaaagtctaaaattaggcatctgcatctggtgagggcttcagactgcttcaactcatggtggaaagtggagggggagtgggtgtatgcaaagagattacatggtgagagagagagcaagagagagaaaccaaggaggccaggctctttttaacaacccactctcagatgagctaatccattcctgagagagtaggagcttactcattcttgagagagacattaatctattcacaggagatccatccccgtgaacaaacacctcccattaggccccacttcctgatactgccccacgggggatcaaatttcaatgtgagttgagggagactaaccacatccaaaccacagcagccccacaaaagaaactccataaagggaaggtagtttcttcctccccatccccaagccttaacctctctcctacaatttctgtaggcctccccctcctccttggagaatgtgttcctatcagccgagctgaaaaacagccaggaggctcatctgcgttcgcctccgtaggcaaagtgacttctgcaacaccaagcctagagtgcgtttatctctccctgagtcaaagagattttgtctataggcctttctgctgtgttcctccagagagaggtaaactgcccttaagtaattgctgaagaaggcataaaccagggaaatttgatttgagcatgcaatttgaatcgggaaatgctcatataaataaccggagcagctgaatgcggcgcgtttgtgctttatagattttttttttttttttttttttttttaatctcagggtcttcagaatacaagttctgctgcagcagcttaaaccacctcaggtctttgcactttggccttgtcctagtttggtactgttaactgccaggctagagtctggctaagttgaagttgtcttatttatctgtatctttggaaagaaaaaaaaattgcttgaacacccaaacaacattatatcatagaacagcaacacagtctttaaaaaaacaaacacttttgaaccaagaaggagtttggagtcatttagttcaacttccccaatgatggaataaggaattcagagatggtaagtcactttctgggttaactaagattttggaagtatcataatcagcttttgctgcagcaaaaaacaattcctaaatccaagagctgtaggtttctagcttatattatatctgtgccaaaggtcacccatggctctcctgggctgggctgagctctctcctcttgtattctcaaggagcagccactcttggcggcatgctactctcatgatagatgacagaggctgaagagcacagaaccaaatttcaggagttcatttatagctactgattggatatggtgattgtcatatctgttcacattccatcagtcaaaacacgtcccttggctgccaagcccaatggcaatagggcagggatgggaagcatggctagagtggatagggtgcaagtcattgtgagcaagtgatacagtccaccactggagagtggagaaactcttgcagtgatgaacgtccaagaagaaatgtgaaaactgagaaagtctttgatgtttcctgaatccacttattcttttagtgttactgatgttaatgaataaccacattcacccagtgatgtaagcttaatatgtgggtgtcattccagatcctccctcatctctgcttgttacatccaataatcaaccaaactctttccttatcagtacttaccaaacatgcctcaaatttcccccttcttttcacacttcatttcccaggtattttgcctacaggctctttccctccaatccatgcactgcaccatggccagagccacttcctctcatcctatctaggccactttcttgggtaaagtccttccacacttataaggataaaatgccattcttctaatgtcgccttaaacattcagttcctgctactccctccccacctacagctggccctgggttcaatatttactcatctaagagcagccagtttgaatattaaccaggtcagtatggaagcaggacttgggacatgctccagtctctgctgggatttgctaagtaggtgagaactaaataagaattgattataagtctcagaaggatgggaggaggaaagccaagcttctataatcaattctttgtttatagaggaggtgatccttcattttctctgagggctcagcagaataatggacttcttttttcccaacactagggtccagaaaatattactcgtcacctcctacaatgtaagccccattgagtatcccaggattctgtgatgatttaactatgaatcacccactcccaggtattggagagttgactcttgctttgatttcactgagatttgggatcatcctggccgtctttcctccatcctctattaatgagtcactggactatgctggaattagctggatattccacattgtttatcagtggctgtgtgcttttgtggcatgttcaaccattctttgtggctataatgcattttatgctccaatccataagtcctttacccctcatcctgattttgatttactcctcttgttaatctagaaaactgctattcaatatcatgagcctggctcacagcatctcttcattgaaagctctctttctggagtttacacactactggcatgaagactgttttcattttctttggtttttccctctgctacattttctctaggttctcaagcctctctctctcctcctctttgggtttcagagtcttgcttctgcagtgagggctccctgcctctgttcttgtgtgagtatcatctcctatctgatatgtgtgtttctggtgaagctattttatttttcctaaaaacaccattgtacaatgttctttagaggaaggaagttggagttttttacattatcttttttaaaaaatttatttttatttttattttaagttctggggtatgtgtgcaggttgtgcaggtttgttacatagataaacatgtgccatggtggtttgttgcacctatcaatccatcacctaggtattaagcccagcatgcattagctctttttcctaatgctctccctccccccaccccacccccccaacaggccccagtgtgtgttgttaccctccctgtgtccatgtgttctcattgttcagctcccacttataagtgagaacatgcagtgtttggttttctgttcctgagttagcttgctgaggataaagccttccagttccatccatatccctgcaaaggacatgatctcattcttttttatggctgcatagtattccatggtgtatatgtaccacgttttcttgatccagtctatcattgacgggcatttgggttgattccatgtctttgctactgtgaatagtgctgcaatgaacatacgtgcacatgtatctttttttacatttttttttttagctcctatgctgtcctgcacattatccccttcattcacttagttaattaatattggttgacagtttactatgtgccaggcaccatgcaaggcactgggaatgcaactgtgaacaagagtgacaaagcccctgccgtcatgataccaattgactaggggggattatggcatccaacaaactcacatgagtcaggcggttaccaatggggtgagtgctgtggaagaaataaataaggtgatgggctggagagtaactgggagaggtcacttggatcgtgaggtcaggaccacctctttgaagaagtgatgtttcaattgaggcctgaaagatgagaaagaactaggcttgggaatggatgagggaaagagtaagtgcaatgagaacaagggcacaggcttggaggcaagaaagtgcttgaggggcctaagtcttagccaacaatcaggagtgtggtctgagatgaggttataggagtgggtgtggatagaacatgtgaaaacttgtaggctattttagtaactctaggctgtatctaagaaaatgaaaatatattaaaggattttaagcagaggaatagcacaacatgatttaccatttcaaaagacaaccctagatgttgtgtgtattaaaatgggaagcagggatagacacaaaaagttcactttttttttttttttttttttttgtaaggaggcttttgcagtaacccagacaaaagcaggtgccttagactagggtaatggccatgtgcttacagaagagtggaagtcaagacctactttggtgataaaacaaacgggacttgttgatctatcgaagatgagttctagcagagataaatcaaggatgactttgaaagcaaggatggtttttgccatgagcaactgggcagatgcagaggccttttactgaaatatgaaaactggcagaggagcatgaggttggataaaatgagagctctttgaagacataacaaatctgagatgcccataagggggcgtgatgactaattttatatgtcaacttgacggggctaagtggtgccgagatagctggtaaaacattatttctgggtgtgtctgtgagagtgtttctggaagaggttactatttgagtcagtagactgagtaaagatgatcactctactgaatgtgggttggtatcattcagtccactgagaacctgaataaaaaccaaaggcagagaaagggtgagtttgttttctctgcttgagctgagacatccatcctctcctgcccttgagacatcagagttccaggttcttgagccttcagactcaaactgggatgcacatcattgttctcctggttctcaggactttggacttgcactggaattacaccccagctttcctgattctacagtttgaagatggtagattgtgggacttctcagactccataatgaggtaaaccaatgtctcatatctttctttttttaacttttattttaagctcaggaatacaagtgcgggtttgttacatcggtacatgtgtgtcatgggggtttgctatacaaatcatttcatcacccaggaatgaagcctagtatccattaattatttttcatgatcctctccctcctcccaccctccgccctccaaaaggccccagtgtgtgttgttcccttctatgtacctatgtgttctcattatttagctcccacttataagtgagagcatgcggtatttaattttctgttcctgagttagtttgctaagggtaatggcactcactgatcattagagaaatgcaaatcaaaactgcaatgagataccatctaaaccagtcagaatggctattattaaaaggtaagaaaataataaatgctggcaaggttgtggagaaaaaggaatggtctggcgcaatggctcatgcctgtaatcccagcactttgggaggccgaggtggtaggatcatgaggtcaggagatcgagaccatcctggctaacacagtgaaactccgtctctactaaaaatacaaaaaattagccaggcatggtggcgggagcctgtagtcccagctacttgggaggctgaggcaggagaatggcatgaacctgggaggcggagcttgcagtgagccaagatcacgccactgcactccagcctgggtgacagtgtgagactccatctcaaaaaaaaaaaaaaaaaaaaaaaaaaggaacacttatacactgttggtgggagcataaattagtctagccattgtggaagacagtatggtgattcctccaagacctaaagacagaaatactatttgacccaggaatcccattactgggtatgtacccaaaggaatataaaccattctattataaaaacacttccttaacctgcacaatgcacatgtaccctaaaacttaaagtataaaaaaaaaaaaacaaaaaaacacttccacacacgtgtttattgcagcactatttacaatagcaaagacatgaaatcaacctaaatgcccatcaatgatagactggataaagaaaatgtggtacatatataccatggaatactatgcagccataaaaaagaatgagatcatgtcctttgcagggacatggatggagctggaggccataataaatcttcctgtgtatctctatatatcctatttgttttgtttttctaaaaaaccctgactaatgcagaggctcaagccatctgtcttccactagactttgctgtatcactaatgttgagcacagtgcttgacatgtaacaggtactaagaaagtgttgaatgagagaattgaaatgagatgcttaaaagctacagatgactaatggcttctatgacaacggacaatcagagtccctagcaatggctaattaaaccattccaatctgatgtccaaaatattgtgtgctagagaccccctttcttttcccattaattgaacaggccctgtcttttttgctcttgtagtcaattgttcttcaagtgtaattagcccttgcattttgacagtaaatgagactccaatacttcgataaatggcttgtttctggaaaaggagtatttgtgaatagaaaactcagtcgtcttccccctttctcccacctcttcctcttccccctaatttgggtggcccttggcctatgttattaccttcagaaaggaacagtgtttcttcgaaaaggatagcaacacagaaagaatagttatcattcattgaacacctgttacatggcaggtgggtacattctatgcaatgcaacaatcctgaaaagtcattttaaaatatctttatgttccagccgagtaaactgaatgaagctcattgagactgaagaacttgttaaaattccacagttactaggaggctgaatcaagattcaaacacacccaagtttgtctgatgccaacatctgtcccttttctgtgattcggtgtctcccttagaccgtaaggagttggcccttgttgagaaactcctatggcctcacttgttagtggaaaaaatagcagtggctttgcctgttagcaaggaacaaacacccttccacttcgttcagatttcttaactcatgtgatctgttttggtcttctcattaaccctctgggggtggggggagtgagtgacaattatcacccgcattaggtaagaaaatggatggtgtctcacatagcttgcagtgggcgggtatgagcatcaaatctaggcagcctgaccaaccaagtcccctcctttagcctttacatgatgtgctctttttcagctgtctcgcccttcccaattgacgaagattctttgttcacattcgtgatcttatttggtgtgggaacacagagactgatttgctgaatttttttaagagctggaaacactatggaaggttgtctaaactaattcaaatgatttcccttgtcttgacccaagggggatgtgtgaatttctcaaaattgtccacatgacatcatgctcattaggatagtcaccatcaaaagaaaagaaaataacaagtgttggtgaggaggccaagaagttagaatcttcgtgtactataaatgggactgtaaaatggcataggcattatggaaaattgtatggaattttctcaaaaaaaatggaattacaatattatctcacaaccccacttttggatatacatgcaaaaaaaaaaaaataagcaggatctcaaagaaatcttagcactccagtgtacattacccaactatttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccattacccaactatttgtaatagccaagatgtgaagtcaaatgtccactgatggatgaatggatgcagaaaatgtggtctatacatacaatgaatatcactcagccttaaaaaagaaggaaatcttgctatatgctgcaacttgggtgaaactcaaggacactccactaagtgaaataagccagtcacaaaaggacaaatactctatgattctgatcaaagaagtatctcaagtagtcaaaatcataggaagtagaaagatggttggtaagggctgggggaaaggagaggggagggggaattagtgtttaatgggtatagagtttctgttttataagatgcaagtctgtggtgttcttttttgtttgttttttgagacggagtcttgctttgtaacccaagctggaatgcagtggaacaatctcacctcattgcaacctccacctcctgggttcaagggattctcctgcctcagcctcctgagtagctgggattacagatgtatgcccccaggcccgtctagtttttgtgattttagcagagatgaggttttgccatgttggccagactggtctcgaacttctgacctcaagtgatccgccggcctcccaaagtgctggggttacaggcatgagccactgtgcctggccagatgaaaaagttttatagatctgttgcatgacaaagcgacttacacttaacactactgaacggtacattaaaaaatggtggaagatggcaaatttaatgttatttgttttttactacaaagaattttgaaaacactgcggtggatttagcacttgaccccatgtcaccaggatccagtgaagtttgagctgcctaaaaatgaatgttgctttctttttttttttctttttggtccagggctatgcttctctcttaggttgtgtgttattttctttgccatagcaactttgagaagtaaatgggtgcttttgctacacctcagggggaatcaggtaagtgaggtaaacctaccagagagtccacctcttccaaggtgcattcattcatctcccttagaatggagatggagttatgaagtaaccaggggtggcattatcagtcctacatggggaaaccaagactcagcatgaccactggagtgttcagggtcacctgagggtattggtgatggagggtggggtgagacaatatcccaggaattccgatgctgggtccagagttagtgaagtgggaggagtggcacatttttaagacttggaactgaagaaaatgttgagaaacttggatgcttttcttatttttattattctatgtaaggaactttctacagcactaaagtgaatagttccattgagttgtccagccctgacccttgatctcaatgcccatcagtggcctcagacttgggctttctttcaggctttctttcatcctccaggctgtggggccctgtgagccttcttcttccccagcggtagatttttctttttaatgtttgaactccagaggcccccaagggcttctgccttaattaaaatttaaattcacaaatcatgtcttaaaccgtctcacaggcagccaaataatcgcaatcattagcaagtggttggagttgcttttgctttaatgcttttcaagggtgatggatacatgggcttagtcccatcattactgctgtcttctaccacccctctctccacaaaccttgctcagaaaacttttctataacacctttgttttctcttgtaatagagaagcctgtgttcttggttcagaatgtattaatgtgtcttggtctgtccctacccctgccttctgcagcttgcccatgtcctggaggccgtcctcatttggggaccagtcaattaccaggtaatggcttagagcacagacagagtgaagacccaacacaaggctggacgggcttccctaggagccacttctggactttggcattgggataggtcctttagtctggttatttgctcctgggaatttgcagagtgtcccacagctgtgcttcccctggtccagggtggctcaaccttggcactgccaacattttgggtttgacagtttgttgtagggagaatgtccggtgcattttagaatgtttggcagcctgcctgttctctacatactatatgtcagtagcagtccccagttgtgacaaacaagtgtcctgagacacggccaaatgtcccctggggcaaaatctcccagttgagaaaggctctagtccaacggcctctctaagaccaacacccttctctcagttcattttgtgttgcaggaatacctgaaactgggcaatttatgaagaaaagaggtttatttggctcttggttctgtaggcagcacaggaagcatggtgctggcatctgcttgtagtgagggctttagggagcttccagtcatggtggaagaagaaggggagcaggtgtgtcccatagtgagagaggaggaggtgccactctctttttaaacagccagctcttgtgtgaactaatagagtgagaactcattcattactgtggggagggtaccaagccatttgtgagggatcctgcccctccatgaccttgactttttatgacttacccttagaagtcacatagcactccttctgccaaactttataaattgaggcagtcataaatccacccatattcgaggggaggagacacagaccccaccttttgatggcaggagcatcaaagaatttgcagccatatttgaaaactgcacctcatttctattcccacgttcagagatgtgaatttttccaagcctttagcagataattcaatcccgccttgaaaaatttcaccaggtgtatttacaccaaaagcctacttcaattaatcaattctaatgctccaattactcagcttatattttcagacactctaataagcaccacaaatgaataggaactaagctgatggtgcatcaccctccactattaaaaagaccacacttgatttctcaagcagcctttacctttgtaaaatgaatttccttctctcacttgtatttagcacaggaaaatgtttccttagggttgtggtggagttgggacagatgggaagacatctaagaacatgtagcaattgtaataaaggtaaatttgttttttttcttgctttttttttttttttttggagacaggatctcattctgtcacccaggcaggagtgcagtggcatgatctcagctcacaaaggttacattttaaatgaagactgaagccttgttagtttgtgatttttgtcatgttgggaaggatgtggactcctattcagactctaggattaaacaacctgggcctcagtttactcatctgtagagtaaggggttggacttgatattttccaaaacctctaccaggtcctaaattgtctgtgattataggaatatttgccaagggcgattttctaacatcaatacccagagggagcacccatgtaataatcatattcattgacatgaatcatattcattgatatgaatcatattcattgaatagcttgccttcaagaaatactgtggcacttctggtaaccataccttttactctgcatttacttaaatatgtacatgcatttttacataagtggtagtatacattttcttttgtaatttccttttttcccctaccactataatacatgctgaaaagcttccatctcagtacctataattaagcttaattcttttttttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcataatattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagagatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgaggtgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatattgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggtaggcctggtggtgacaaaatctctcagcatttgcttgtctgtaaagtattttctttctccttcacttatgaagcttagtttggctggatatgaaattctgggttgaaaattcttttctttaagaatgttgaatattggcccccactctcttctggcttgtagggtttctgccgagagatctgctgttagtctgataggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgtcggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctagatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccatgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgcctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcatccatcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttcaagcttaattcttttccactgctacataatagtccactgcacggataacttaaaatccgctatagggattatttaagtgtagaccattttgatgtaaatttaagttactttatttcttttgcttttatattagcaatgcttcaatattagcaatgctgcaatgaatagcactgtgcatacgtcattgtgatggttaattttatttgttaactgggctaagggatgcctagatagctggtcaaacattgttttgcagtatatctgctaaaacatttccaaaagagattagtgtttgcatcagcagactgagtaaagaagatggccctcagcaatgtgggtgggcatggcgtaatccgctgaaggcccagatagaagaaaaaggcggaaaaagggtgagttctctgtcttgttgagctgctacattcatctcccacccttggagactggagctcctggttctcagggctacaggctctgggacttacaccagtggcctccccagttcttggtctttggacttggactgaatgacatcactggcttcctgggttcttcagcttgcagatggcagatcatgggacctctgggccaccacaatcatgtaagctaattcccataataaatctttgcctatatatactgtattgattctcttcctctggagaaccttgagcaatacagtcattttgctcctatgcagttatactgtagaataaatttctagaagggaatttgctgggtcaaaagttatgtgcttttataattctgatagctatcgacaaatttctcatcacagagatcataccaatttgttcctcaatcaataatgtataaaagagctttgtcctcctacacagggtatgatcaaactttacaattcttggcactctgataaggcagaaatggcctcattatggttttaagtggcatttctcctttgtgagtaagctagcatcttttcttatatagaagagtctttcgtatttctttctctcagaaaagtatccttatagactgtgaaagggcataacttaaaacatttttatttatttatttttaattattatactttaagttctagggtatatgtgcacaatgtgcaggtttgttacataggtaatacatgtgccatgttggtttgctgcacccattaattcgtcatttacattaggtatttctcctaatgctatccctcccccatccccccaccccatgacaggccccagtgtgtggtgttccccgccctgtgttcaagtgttctcattgttcaattcccacctatgagtgagaacatgcagtgtttggttttctgtccttgtgatagtttgctcagaatgatggtttccagcttcatccatgtccctacaaaggacatgaactcatccttttttatggctgcatagtattccatggtgtttatatgccacattttcttaatacagtctattattgatggacatttgggttggttccaagtctttgctattgtgaatagtgccgcaataaacatacgtgtgcatgtgtgtttatagtagcatgatttataatcctttaggtatatacccagtaatgggatggctgggtcaagtggtatttctagttctagatccttgaggaatcaccacactgtcttccacaatggttgaactagtttacactcccaacagtgtaaaagtattcctatttctccacatcctctccagcatctgttgtttcctgactttttaatgatggccattctaactggtgtgagatggtatctcattgtggttttaatttgcatttctctgatggccagtgatgatgagcattttttcatgtgtctgttggctgcataaatgtcttcttttgaaaagtgtctgttcatatcctttgcccactttttgatggggttgatttttttcttgcaaatttgtttgagttctctgtagattctggatattagacctttgtcagatggatagattgcaaaaattttctcccatttttgtatgttgcctgttcactctgatggtagtttcttttgctgtgcagaagctctttagtttaattagatcccatttgtcaattttggcttttgttgccattgcttttagtgtaacttaaaacatttttaatagatgtttttatatttttctagtgaatccactccatgacatcaccttgccttcctcttttttttttttttttttttgagatggagtctcacttggtcgctcgggctggaatgcagtggcacgatctcagctaactgcaacctccgtttcctggagaatcagtgaactgattctcctgtctcagcctcttgagtaccttggattacaggtgtgcaccaccatacctggctaatttttgtgttttgggtggagacagggttttgccatgttagccaggctggtcttgaactcttgacctcaaatgatcctcccatctcggcctcccaaagtgctgggattacaggcatgagtcaccacgtctggccctcgccttcctctttatgccagtttccgaagtcacatgtaagcccttaggcagatggtgggatcctcattctatcactctatccctttatggttttcttagttgtatctttaggtggagtgaagcgggacagctaacacagtgacctccagtagccacagaatttgttggtatttgctagaaatacatttggtggataatatggaccatcaaagctttactttgactccaccctgcaattttgtccaagtgtctcaggaaatgactgcacttcatttttgctgaagcctatttctctgcagtacattttgtaatccttatgggttttatcataagaaaaaacaactcatggtctttctagaaaaagtcaaacattggctggtttcatcgtttatcagcatcagctctttctgctgataatgctggtaacaaaacttctttctctcagcacctctttcagcctgactgttaaggttttgatggagaggaggtgggaagcccaggcttgactctaagcctaagccacacttgtcaatgcagttaatcagaaactttgcattgttactggcccctgcccaactagggataaagatgacactttacttagattttcatgtgatctttatgtctgggaccaaccggttaaaatcccagaggaaggaagtttgggcaattggctagattccagcattttccacacactggattctgtgttagggatactaaaatgaattaataaaatgcagccctggccaggtgcggtggctcacacctataatcccagcactttgggaggccaaggtgggcggatcacgaggttgggagtttgagaccagcctgaccaacacggtgaaaccccgtctctactaaaaatacaaaaattagctgggcatggtggcgtgcacttgtaatcctagctactcaggagactgagacaagagaattgcttgaacccgggaggtggaggtagcagtgagctgagattgcaccactgcactccagcctaggtgacagaacgagactctgtctcaaaaagaaaaaaaaaaaagcagcccctggtccaaagtcactcccacatcaaagcaggtcccacctataagcagatatttataatacaatgtagtaagtaccatgataaaagaaatctttccaatctaactcatagaggaagggttcctggaggagataaacctcggtaaaaacattagtatgaattggtattagataaggtggccagaccatgtgatcaaataaatagagatgtgaaataaaaaggtacgtatgtgtgccatgataagtggtgtttctggagcagaaattatgtcatgcgttagtggttgaagaagtagacagaacctggtgaaacctgtttgttctctaaaagacttgtaatttatcccgtagattaactggtttttcccatggccagacacccacagatagcatttcaccctgtaataacttctcttgggtgtgcctaggcttctgcatgattaccagctcattggctgtatcagcaacccgttttttctatccagtgagtgtgaaagagatgaggtttctacggtccttaaaaagcctggatccatcagcattggagcttggagaggagttgaggtaaaagaaatgcaatctaccaacagatataatgtttaagtatcttactttttactgtaaaaagtatcaaactttttactgtagagttgaatcatttatacattttggtttaacctaattcaatttcttttcttttcttttttttttttgagatggaatctccctctgtcacccaggctgcagtgcagtggcacaatctcagctcactgcaacctccacctcccaggctcaagcgattttccttcctctgcctcccaagtagctgggactacaggtgtgcgccaccatgcctgactaatttttgtatttttagtagagacagggttttgccatgttagccaggctggtctcaaactcctaacctcaggtgatccacctgcctcggcctcccaaagtgctgggattacaggcatgagccactgtacccggccctaattcaattctttatgctgattaaagaatggaaaaagcaggagatgggacatgcaagggagaaagtggggacagtgtaactggcccagccaattctgtcctctactcatggtataagagagcatgagacaggaggactgacgttcatgccccatcatcagccttggtctcccatgtggctttcataacctgagtatctcttggagccaaatgggagtctagtgtttagaaatatgtgtttttcatacaacctgggtgctaaacacaagataaacggttcaccaaagaaccagtgagtgatcaatttttgctgggagacagactggcctggctggccatatgaaaaacccagcatatgcagttgactctctgtatctgtgggttccacatccatggattcaaccaactgtggatcaaaactacatggaaaaaaattgtgtactgaacatgtacagactttgtttcttgtcatttcctaagcaatgcaacataacaactatttcatagcagtgacattctattaggtattataagtaatcagacatgacttaaagtatatgggcggatgtgtgtagattgtatgcaaatacgacactgttttatatcgggaacttgagcatccaccagttctggtatctatggggagtcctgaaaccaattccccatgaataccaaggagtgtctgtattgtatttaatgggcactggaagggattcaagagttattttgattatatactctctacttgccttgctgagttttttaaaacataacacccaaatgggaagcaaaattactttgtttatgtttctcaaagacgatgaaggagacaaaaacctaagttcacagcaacctcatgaagctcctcttttatttcccatcctctcactattcttatatttctccagggcattcctccctccgcacagccctgtgaagctctcctatctcttcctctactctgtatccttttatttatttttattttattaacttattcactttggaatagggtctcactctatcacccaggctgaagtgcagtggcacaatcatggctcactgcagcctcgaatttctggactcaagcaatctcccctccttaacctcttgagtatctgagactataggagtgcagcaccacactcagctaattttaaattttttgtagagatagggtcctattatgttgcccaggctggtcttgaactcctgggctcaagtgatcctcctaaccttggcttcccaaagtactgggactatgggtgcgagccactgtgcccagcctacattcttctattacataagatgatcggagcttgtctccagccaacaggaatcattattatttctgagggactatgagtgggtgggcaaaaattgcattttctttttctttttttttttttttttaacagccagggtctcactatcgctattgttgccccagctggacttgaattccagggcttaagtgatcctcccaccttagcctcccaagtaacttggactacaggctatgccagcatgccttgcaggatttacattgttaatcataagatactctctgtgttatggaatgaattgtgtccctatgccccccaaaattttatgtgttgaagtcctactcaccagaatttcagaatgtgatgatatttggagatagggtttttacagagatagttaagttaaaatgaagtcactggggtgggccctaatccaacatgactggtgtccttataagaagaggatatttggacacagacacatacagagagaggatgacatgacaataccagaagttggtcatctccaaaccaaggaaagaggcctcagaagaaagcaaccctactgacacgttgatctcagatgtccaggttcttcaactgcaagaaaattaatttctgttattcaagtcacatagtctgtgatattttgttttggcagccctaatgcaccttggaaggggagatcacttagacaaacaatgcctgtcccattccactccagcctcttcaaatttatacatacaaaggagaaccactcacgaacattggtattttgtgtttttttggtcacgtattacttgtgctgcccatcacagcttactagaagactgaaaaacattgctgtaggggagaaggggccacaggggaattcaaagcagagaaggacgtgatggatctgaattttgggtggatcacaccaacatcaaaagtgaagatggattgaaatagggcaagacaggagatggagaactattaaaatgctttttcggctgggcatggtggctcacgcttgcaatcctagcacttggggaggtcgaggtaggcggatcacgaagtcaggagtttgagaccagcctggccaacatagtgaaagtccatctctactaaaaatacaaaaaaaaaaaataataattagctgggcatggtggtgggcacctgtaatcccagttacttgggaggctgaggctggagaaatcacttgaacccaggagaaaggaggttgtagtgagctaagatcacaccactgcactccagcccaggcgacagtatgagactccatctcaaaaaaaaaaaaaaatgctttttcattcagtagcagcagggatggagaattagggatgggtttgataaatatctaggtatgagaataataatattgggtgatagaattggggtgatgaaagggagtagagatggatgatttctatctttctagtttaggtatctgagtatacaatggcactgccaatagaaagcaactatagagtttatttgcatgccactgtattctagaaagaactgaagttggcttatacaaaaactgatcatgccataataaatagaagtaaatggggaaagcgaagctggctgtgcttgaaaactggaaagacaaaatgaagccaagagcgaggttagcacacaaatcctcatccagggattcttaacacttgtcagagatggactgtacattttgctttaggccaacacatgacattattcacacttgtcattttggtcaatgtttctcacctcttccaaggacctggagtctgaaaattctaaaacaatgaaaatctggctgttggcttctgggcgtgagaggcaccaggaatactgggagaggctcagattgcatatttggagactcctcagagagaaaggtgtggaaagtttaaaaagtgtggagcatctcctgcctcaccttagggtagggtggaatctggcgcttgggttcagagactgggaagatggactgtctgtacttccatgcaacagtgtaaaaatccattgatttgggaaaatgacatggatgtgtcatatgccttctgtggtgccacttgactgatttacataatattgctgtttttgctatgtgaatacacaggttacataagcagtctggcagcttaagtctcattactgtcatttccaaggtgttagattgttcagaacaagggaaccctttctgctacagaatctaaagtgaatgtatccccatctaggcacatttcaatgatcccttcatgatcacacctttggaatatgcccaaatagccagtttgataaccttaggttggaaaagggaatggttgttcccaagctgtctttcccagagtgtttccctcttgccaagtgttgagtgaggttcaacaggtttatgttcctgcctatggggcacctttctctatggagaaaggacctttagaaggactatatagagagaggtgagctctatacaacagctcttggcgctaataatactacaccttgatgggtccaggactggttggggcctgacttgctgatcttttttgcttttataatttcaacttttattttagatttaggtggcacacacgcaggtttgctacatggatatattgcctgatgctgggtgcgatacacatgatccagtcacccaggtactcagcatcatacccagtggttagtttttcaacccttaccctcctccccttcccctctagtagtcccccagtgtctattatttccacctttatgtccacgagtatccagcgttcagctcccacttgtgaatgagaacatgcaagtatgtctaagatggtgtctccactccatgcatgcctccttctagacaggatctggctggctgtgggcagtattgtggagttggtaagtttcctctgtgcgagtttactcttccttttctttcaatgtgtaccagagtgatgggattggctttggagtagagatatgactctctctggccagccaagcctggtacaagtaatttaactccttggaatctcagcttcctcatctgtaatgtgcggaagataacagcagcctcacaggactgccctgactgcaatcacaatggaaatgagtggctgtgaatttcttcacagcgtcctgatgcaagaaaggcccaaaatacttcactcattttattgatttatttatttacgtatttttacatacatacattttagggacacccaggctggagtgcagtggtgtgatcctagctcactacaaccccaaactcttgggctcgagcagtcctctcactttagcctcccaagtagctaggactataggttcgcaccaccatgcccagctaattttttatttttagtagagaccaggtcttgctttgttgatcaggctagtctcaaactcctgatctcaagtgatcctcccacttcagcttcccaaagtgctgggattacaggtgtgagccaccatgctcatccactttacttgttttaatcagagtaaatctggctgtaggctctcaagaactacagtgttgagaaaataaatcacagatttctttaggagcattccctaccaatccccaaagatataaatggtcttttaaatcccttatttgggatttaaaaattagggagggggccaggtgcagtggctcatgcctataatcccagtactttgggaagccaaggtgagcggatcgcttgaggtcaggagttcaagaccagcctggctaacatggtgaaaccccatctctactaaaaatacaaaaattagccgggtgtggtggtgcgagcctgtagttgcaactgctcgggaggctgaggcatgagaattgcttgaaccccggaggtggaggctgcagtgagctgagattgtgccactagactgcagtctgggtgacagagcaagacggtgtctcaaaaaaaaaaaaaaaaaaaaaaaaaaaggaaaaaacatgagggaggggcctggacctcagtccttggagtcaccagagttcctgctgctctttctgctccatgatgctcctgagtttgtcctgcttgctttctcagcctttgttctctcgacagacccagggctgttcctcaagaccattgtattttcttctagccagaagtttgaccacatggaattttgccagtgctgtccaagtcttggcactgtatccaaccaccctggtatccctgagatctgtgttcaaagacagcccagttctaatcacctgtgaaaaccccaaacctccacactcttcaatgttatgggaggccaaggctttacctgcctccaggcaccccaaaccccaactgtctccccgatctattttccttcctcatgaatgagcttatgtttcctaaacaaagctgggatgagtcttatgtcctggaagtctcatagtttctactgagttaatattgactctagttgtcctcagtagccagtttcttcttcactcacaccaacagaatgtttagctacacaggaaatgcctagaataaggctgacattttgcagcctgcctcatagctagggatagccatgtggttgagttctggacaaagagatttaggtagaaagtgtgggtggcagcttctgggagccttctttaagggacatacctgccctttgatgttcttttcttcttccatcttgctgtctcctatgcagctgctgccatcttggaccaagcacatgatggtcatatcctaaaagatatcagaatggtgagttggtaggagactgagtctttgtttataagacaagacacagagtggggaaaaccccttttgtttggtccaatgtcatgacaattgagcatcaaagggaagaatctcaaggaccaaggttacctgctgagcatgaccaaacccaagagagcccacgtccttaatgacatcacttacccaggagcctcctccctccagactccttctgatgggagatgagatgagacattttccccactgtttaagccacttttctttggatattttattgcctaagagcaccctaaccaatgggatataaagaagaacagtctcagagcacaagggttgtttacttgtttttcagatgaggcagggaaaatccctcttgatcttttgagcatccttcagcaacaagaacaaacacaaacaggtatctcagtaaatgatgcccccatatgtaaaaaacacagcatggaacctgacacatttaagcagtcagtaaaaggtagctattcttctttttcttagtagcataatgcctcaataaacattggtttctgatcctatccccttgagtatctctccctttgctgctaagtttctccatacctttacatttatctcccttctcccctattaaacctggctcttgaaaagactgtcaacttgctctcattgaggtgtcagtgatagataaggcttaatgtatgacctcattccccaaacactatcggcttgtcagtgagatttacatttaatagaggattaaagccttaagccaaaggaatgaatctttaatggtgaaatttgaggcaccagaaggcttatgaaaaacaatattgaagagggggaggacctccttggtgatcccaattttctgaggcattctcataaagttctccaaattctcccaaatttaaaaacgtcatgccgtactgcacttcacaattggcagttggcagacagattctggatgaagctttgtggaactgaacgggagtgggagggggaatcgtgaaatcaaaggcacaagaagagggtgtctcaattccagagggagttgtctgttgagtgggtgagtcaggctgtctgagcatgtggatggaacttccctggggcagctgcctgtgttgagccacatttgatattgacttagcagtttcctgctgcttcttgaccttttttttggttggggctggtggttgagctgtatcaagttatctttctatcccaccctcccagtttcttccctgaacctcatcatcatctcagttcttctccctgcttgtcctgccctctacaaagtgcctctttggccaggcttctcaaatactgtgagcaagacttggaatctctcttctctccttgcacccaccactgaatctttgggcatcttggccgggtccccagcagtgcagacctgacaggctgcattcttggtcactgggatttcttctctgagctccagcttatgctgcttccttttcagcatctcctcttgagtatcccacggattatttatttagttatttattttaattttttgttgttgttgagatgaagtctcactctgtcacccaggctggagtgcagtggcatgattgtggctcaatgaaacctccgcctcacaggctcaagcaattctcctgcctcagcctcctaagtagctgggattacaggagcccaccaccatgcccggctaattttagtatttttagtagagatggggttttggcatgttggccaggctagtcccgaactcctgacctcaggtagtacgcccacattggcctcccaaagtgctgggcttacgggtgtgagccaccttgcctggccctgattatttatttttttgagatgaggtctcactctgtcactcaggctggagtccagtggtgtggtcatagctcactgcagcctcgaagtcctgggctcaagtgaccctcctgcttcagcctcccgaggagctggaactgcaggcatactattattagtgcttggaacacttagcaacatacccagctacgttgtaaattagagacgaggtctcactatgttgcccaggctggtctgcaacttctggcctcaagcaatcatcctgcgtcggcccgccaaagagggaccccactccaaagcactgggattacaggtgtgagtcactgtgcccaacccctactgatactttaaattcaacacatgtgggtcaattatgttccatccatcccctggatgtgctcttcacccacctccaccttgttccttccatggcagatggagtcattggaacgtcatcacctctggctgggtttgaccaattaggaggagaaaggagagaggagggaggagtgaggcaggagtgggaggctgcagtgttcatcccctaaaggtggtctccgccggattgtgttcctccaccaaaagcctgctcctttctagtggccttctgtacctacacgactccctctttccaggtcttggcaactattccctgtccttgttcccccaagcttggaggcagtggcagctcctccactgctgctggcctcgggtgactgctctcacccttgcagtggttcccttgcgggagattggcatcacctggaaacacattaaaattgcagacttggggctacctcccagcccttctgagcttgaaattaggggtggggcccagcagtctgcatctgtttttaatttttatttttattttaagttctggggtacatgtgcaggatatgcagtttttgttacattggtatacatgtaccatggtggtttgctgcacctgtcaacccatcacctaggtattaagcctagcatgcattcgctatttttcctaatgctctcccttcccctagcccacccctgacaggccccagtgtgtgttgttcccctccctgtgtccatgtgttctcattgtccagctcccacttctagctgagaacatacagtgtttggttttctgttcctgcattagtttgctgaggataatggcttccagctccatccaagtccctgcaaaggatataatctcattcctttttatggctgcatagtattccatggtgtatatgtaccacaatttcttgatccagtctatcattgatggacatttgggttgattccgcagtctgcattttgaccagatctctaggtctaggtgattctgaagcacgctcatgtttgagcatcaccaaacttcacctttccagctttgaaattagtaacaaactcttccaattgtgccaaatgaacatttcctctgttttctattgtgatcctaatgatataatgacaataataataatagaattcagatccccggcataaaagtgacccttgtctagggtctctttctcaatgaatgcaacaccatgggacttgttcttacacatcttttaactctgcacctaccagcctgtgtggtacattgtaggtgctcagtaaaggctcatttcaacagaaatttcatttttttaccctcatggttttgtgcctttcccaacacaccgtgtatacatccattcatccacccaggaatcaccatatgggtactggggatgtacagccaaatatgatattgtgtttagtctcatgggtcttatgagttaatgggtgagatgtcagctgtctgagtttcagtaacaccatctattaatggatcataatattactgactccatggggttgttgtgaagatgaaatgggataacgcacagagtgctcttggcacggtgcctgacattgaaactattcaatcaattttagttttattactattgcagtagttgatatagcttaagcctggctcaaacagagacgagaacatgatttgtgggcatctctccacgccatgggtataagcgtcttacaagttacaggatcattaaagtactttgtaaattacttggcatttcataaggcgtttatttttattttttaatttttgtgagtacatagtaggtgtatatatatatggggtaagtgagatattttgatacaggcatgtaatgtggaataaacacatcaaggtaaatggggtatccatcaataaggtgtttttatatttactgatctggctattattcttgtcctcgtgtgatatctctgtcttgtttatcctcttcaaggctaccctgtaagtttcattttgacctgcttttattcctgtgcaaaagttagccagcacaaaagagtagcttaataatttattctggattgagacgcccttagggtctgtccattaatttcttcccttccaaaatgactataattttttattgtttttattggttaaaaagatgtatgttcattgctttaaaaaatgaaatgatacaaagcggtacaaagtacaaaatactttatcagttgaaataaatcactcagagatacctcttttaacatgttgctgaaccttttccttgaaatatcattatacatttctctgcaactctatctagtatttccatgttacatgaatagggtcattctatggagccagctcactttttagccagaaactatctgaggaggctctgggaaaatttcgtctggggaggcgcgcttgctctcccacaggaccaccagatgtcgctgcttctgaatttatcagaatttcctgtccccagggcaggctgcagaaattaatgctcaatgttccaatcctgggccctggttcgtaccatccctctggcctagggctgaagatgaattgattttgttttcagtgacacctgcagagggcaaaagtcatgcccacactgtgacatggagtgaacctgtagtggctcttggactgaacaagttctgacatgtgtgttggttatgtttgcacctgttttctcctcctcccccgtccccaaattagatcgtgagatccctgcaggaagagactgagtcctgtaacccagagttctctttctgtaaagccctcaatacctgttaagtctcaattaagaataaggtagcttggggacctggcatggtagctcacacctgtaatcccagcactttggggaggcccagttgggtggatcacttgaggccaggagttcgagaccagcctggccaacatggtgaaactctgtctctactaaaaatacaaaaattagacaggcgtggtggggcatacctgtaatcccagctactcgggaggctgaggcaggagaattgcttgaacccaggaggtggaggctgcagtgagctgagatcacaccactgcactccagcctgggcaacagagtgagattacatctcaaccaaaaaaaaaaaaaaaaaaaaaaagaaaaaagagatggtggctaggaaaatagaggctagaaagaaaaaaaaaagtaggtgttttgaaagcagaaaacaaagtataaaaaattattgagctgggagtcagaaaatccaaattttacatttggattaggtcttaattcactggctgactttggacaagcctattgacctttctggggtcaagttggtttatgtataggaggttggatagaatgatctctcaacctctattagctctgacctccttggatacaaaagttcttcttgtcttttgttgttgttttttgtttgtttttgggatgggaggatgtcaaattgcatctagaagtgaatcattgggcaccgtcaagaaacctggggaactcaggtcctggggcatccagggcaggtcaggcctgaggctgagctgcacttaacaatccaccctccttgcagggccattggcgccggccgcaccagcacagcccatacatcattattagattcccttcatcatgctaattgacatgggatgaaaaatatccagtgaaggaaacagcaaatgctttcacattcagccagggcacctggcaaatgggagaaactgctgtaaaagttaactgagattgaaaacgggcctactaatatcttgtagggtgaatgtttcctgttgccgggaactagttcggattggcaatgtgagtgagtggtggagacagggagggagggaagcttggggtaccacgtgtgaagtgtagaggttggggggaaccttttaagacagtttaggttcagatgcatggagaaccagacagaacaaataaagaaggatagagaggagagagagggagctggtcttgtctcctctaaactgtagtgataattgtacccccttctcagtttgaattctgttgagaattattttctcaagaagagtccagtattgggtggaggggaatgtagaattcctggctctagaccagtctgggggtagaggaggttgcaccccaggggacattaggtaatgtctggagacatatttggttgtcataagttgggggcgggttatattagcatctcctgggtaaaggccagggatgtggcaaaacatcctacaatgcacagggccaccccctcccaccaagcacataatgatcccgtctaacatgtcaatagtcctgaggtgaggaagcccggctctaaaacaatgtgtgactttgcacaagtaactaaacacctccgggtgactattttatcaatctacgtgacaaattttacatggtatggtagattgctggcaaaaatagcccaaattctcctccatgtcccccctggccattgcaatatcactttgcagctcctgctatcaagacatggagtctgttcctcactctttgaatcacggctagcctgtgtcttgctttgttcagcagaatctgcagaattggtagcaccaagtctaggcctcagaggctttgcacagttctgttgtctccttccgagccctgctctcctgtgtgcgtgagcctgggctaatctgctggaggatgagacaccacgtgtacaacaggcaaactgccctaccctgtctatgctaaaaatacaattgctaaaaattgcaagatacagtccagcctagagtaaaactatctactgaccgaggaccatggactgcagaccctagctgagataagaaaacccacccaggtaatccatagtttcctgggagataacagattcgtactttttttttttttttttttcctttgagatggagtttcgctcttttacccaggctggagtacagtggcacgatcttggctcactgcaacctgcctcctgagtagctgagattacaggcacccaccaccatgcccagctaatttttgtatttttagtagagacaggctttcacttgaacccctgacttcgtgatccgcccaccttggcctccctaagggctggaattacaggcgtgagccaccatgcctagctccagattcttactgtttaacccactgaatttcagggtggttcattatgcaacaatagctagctaatatgcaaggtcttgaaattaagactcaacggtgaattccaaggggaatgggaaacatctcaagatttgcttcctttgttaatagctgacattttcctaagtccgatagctttaaatgaatcaagatgtgcataactgcatcctttgatacccaattaatggagctgggcaagttctatctggagacaagtttgctaaaggttaattttattcacttttatcaggacaagttgcagcaatcaactctgacttaaacaatagcgaaagggcattggtgaggacaccaggaagctgatgaatacacagccttcagcaacatcgggagtcagagctgctccagggatcttggcaggagggatttgtggctctccttccagaatgctgtcaagggtgacagaggcctaagcacctttcatcctcatgtaatttgtgctccagatttgaagaccagggtggaagaacctcattggctttccttatgtcacctgctctgctaataggtggtatcgtttgattggcacctctgccattcccacgtagagtggaaaagggcaatcagacagaaacagaaggtgccgtctgcctccctcctccctaccccttcccctgccacccacaaccctacagattgggaaaggtagaattaggaagtatgtttagaatttttggtgtgtggtctggacctctaagatggctcatcatagcctagctggaaaatggaaagcctccgtcagaaattaaaaatcaaatgtaacagtgctgttgactctcatacgactctcctccagtcacccttcacttgtcatgtcagtgtcagcatttgtggtaatggtttgggatgtggaagggggagtgagaagggagataatccttcttcttctccttcttcttctgagacagggtcttgctttgctctctctcccaggttggagtgcagtagcatgatcatggctcactgcagccttgaactcctgggctcaagcaatcctcctggctcagcctcctgagtagctcaggctacaggcatggaccaccccacctggataattttattttttactttgtaaagatagggcctcgctgtgttgcccaggctggtctcagactcctaggttcaaatgatcctacagccttggccactgcacccagtcttgatctgacttttgaagcactatgtatttaccgtactccagcctgggcaacagagagacatcctgtttctaaataagtgttatctcttagtgctatttctattcttgttgtcagcttgcaagttgatagctggggtcaaaagtgtgacagttgtttgagtcagatttggaccagaacattttctgccacttattccaaggagatggcaagggtcagcggggggtcctaaaagtctcgggtccagacattaagtttctgccttctgtaagtcacccaaagatccccaaagtgtcccagctgtagagacacatgaattacctacttcccacctgtaaattaggagggctgtacacaatctgaggtttacaactatttttttcttttaattttcttgaacccttcaagtaaaatcttatgttgaagttcagcacatataactgataaatgtgagtcattttcatagaagcagttgttgtgtgtgttttggggcgcagtggggagcagggggagcaggttggagccctactcatatttggcctccccctcttctccaaagtggctctgaagacatctctaggaccctcttggttttgaggaccacttgtgaagaccatgggaccagtgacattgaggcctttccaagctttgagtacaattctctgtgtgtagatttgaggaaatggtcttcatcagtgctgagatacagaagatagacctggtggagaaagccagggggatggcagatgctggaccaagccattctcctgcctcagcctcccaagtagctgggactacaggcgcctgccaccacgcctggctaattttttatatttttagtagagatggggtttcaccgtgttagccaggacggtctcgatctcctgacctcatgatccgtccgcctcggcctcccaaagtgctgggattacaggcgtgagccactgcgcctggcctcttcatctccttttttgcacaaagcagcacagtgaggcagaagaacaagggctttgcaactctgatcccagctatcgacttctgagctgacaacaagaatattaatagtaccaacagctaatactttttttggggggatggaaatggatttcatttggcatttttaccaaagatgagggtgttccctagggaggtagcccagcagagagcttaagagtctggaatgttgaagacgaacagtctcaggctgtagtccccccagtcctgccacgtgttagctggatagtctctttatggctctgagtctcagttttctcaactgcaaaatggagaagcaacagtatctacttcctagagctgctgagagaatttcagtgtaatgacgaatgggaggtgcttggagagtgaaccttggagagtgggtaaattctacaaaatatagaaaaattgctcaggtggagagtgtacatgaatggagggtgaaagcagcagccaggtgtggtggctcacacctataatccaagcactttgggaggccaaggcaggaggattgcttgaggctaggagtttgagaccagtctgggcaacatagccagaccccatctctaaaaaataaaaaaaattagctgcctattgtggcaggtacctgtagtcccagctactcaggaggcagaggtgggaggataatttgagcccaggaatttgagaccagcctgggcaacatagcaagaccctgtctctacaaaaaataaagtagccgggcatggtggctcccactggtagtgccaactacttgggatgctgaggtaggaggatagcttgaatcccggagttagaggctgcagtgagctatgattgcaccactggataactccagcttgggtaacagagtaagacctcatccgcccaaaaaaagtattagctgttggtactattaatattcttgttgtcagctcagaagtcgatagctgggatcagagttgcaaagcccttgttcttctgcctcactgtgctgctttgtgcaaaaaaggagatgaagaggccaggcgcagtggctcacgcctgtaatcccagcactttgggaggccgaggcggacggatcatgaggtcaggagatcgagaccgtcctggctaacacggtgaaactccatctctactaaaaatacaaaaaattagccaggcgtggtggcgggcgcctgtagtcccagctacttgggaggctgaggcaggagaatggcttgaacccgggaggcggagcttgcagtgagccaagactgcgtcactgcactccagcctgggcgacagagcgagactccgtctcaaaaaaaaaaaaaaaaaaagaaaagatgaagaaaaaggagggcacctctcacctttgctaggagtttgctcctaacattctcttctctaatgctaggggtcccagtccccattctctctcttacaaaggaccattcacttttcctgtcgtcccctgacaagacctccaggagcgaaattaaagcaataagagctaaactgtctgtgatcggagaacagagaatgtgataatgatatataaagcttaaaagcactaagtgggcaaaactggtgctagagaagtgagtaaaaccaagacaaatccgtcccttgagagctataacacataacttaaataaccggagcagcaggggtccgttatcccttggaagagcggtttgcactcccgtggagcacagcctctgcccagcatccataattccccatgtgcttaggactggtcaccacagcctcagggttaactgctggttggatcagggtttctgctgccacctgggcacatgcagcccaccctatctggcagcagacatctgaggtctaacctcagcagtaagatggactggagaaagaactgcatggacactgagaggactcagattttgtttttgcctccaccctttttgagctgtgtgaccttgattaagttacatcacctttctgaagaaccctgtcttttttttaaaaaaaactttctatttaaagttgtgggtctcaacatggggtccctagaggaaaagcatcagtatcacttgggaacatgttagaaatgcagattcttgggccacaccgcagacccatgaaactagaaactctgggggtgtctcctagaaatctgtgttttaacgagccttctggtacatgctgaggttcgggaatgagtcttttaagaaaaatgatcccaacttgtgtttttattccctggcatccttaactcgttaataaggagggaaggagttcaatgttaatgggagctagctgggcttccaggaagttcctgggctaagtcacaagagcttttgttccaggagacatttggggcatgctgaggcaggaggatcccttgagtctgggaggttgaggctgcagtgagctgtgatcaagccactgcgaagtctccatacctctctaagattcactgcaggtgtgtgtacttccttcattccaggcccagctgacttttttcccttccatagtcctttgctctttcccccttcccttctcccagacacaagaaatgctttcagtctgggaaaagttcagggaggtgggaacttgtctctacccaatagcaatttttctatattttgcagaatttatgccctaattccttttagccgtgggcttttgaagctcaaaagctcacgtttggaaactcacaatatgaggcatttgaaatttaaagccttttcctttgcttttctgcagcccctttattaagcaaataaatgctgttaaatcgagttgctgctggagtcagggaaaggaaagagagtgaggagtaatgagagtgatatggaggagagagtgcagtcaatgatttcaaaggtaaatgtctttccacataaacttgtgatataaataaagagaggaacaggcattctgctgaacatctctgggcaacattaccctttatttaaaaaactctacacgccttattttatggagagttctggaacccaagataggaatgtcacttatgtgcatattcttacgccagctttccttcccacataccattatgataactctccatccctgtaaataaccagggggtctctcttccttctgacccttgcacaacgtagctagctggagtgatccatttcttcttcttcttttttttttttttttttttttttgagatggagtctcgctctgtcacccaggctggagcaatccatttctatctttcgtgacacccgtctggtactactttgagaactagatgaaaactagaagtgctttttgtctatttaaaaaccttattatgctggtttcaatgtgttttttggtagttacagttctgagaagtgtggattttgcagttccacactgttaagcatgatctcactgttgtgtatctgggtaaaaggtgatttaaaggcatcgcaaggagccaagcttccatctgatgagaaatgcaaaaagacacaagggggccattcctggaagtgtgaaactctatgttcaacaggaccaagagacgagtcggttgcatatttacattttacatttatgtgatgcattagaatttataaagcgtattcacatgcattaatcactaagatggaattttaacaggcaactggtacgagctgcattggaataagagggattgatagtatttaaggaccagtcagaagaggactgatggtatttaaggaccagttacaaaacaggctggttgcagtgactcacacttgtaattccagcactttgggaggccgaggcaggaggatcacttaagcccaggagttccagatcagcctgggcaacatagtgagacctccatctctacaaaaaatgttttaaaaaattagctgggaacggtggcatgtgcctttagttccagttacctgggaggctgaggcaggaggatcacttgagtgcgggggggggttgaggctgcagagagctacgatcacaccactgcactccagcctgggtgacagatcctgtctcaaaaaaaaaaccaaaaacaagcagaaagtgaaaaaatagtgacagagtatatttctttgaatcatgccttcaattgcatgtgctccttggttaagaacactcattgaggattatatttaacttttctgttttattttatatagaaaaacccatattagagcaaaatataccttagtagtggtaagctgtggtgactctaattaatactgctttctaactactctacaggaaaagtgatctacagggtttacctgtagaaatacagcagtgccatagccaggcgtggtggctcacacctgtaaccccagcactttgagaggctgaggcaggtggatcatgaggtcaagagatcgagaccatcctggccaacatggtgaaaccccgtctctactaaaaatacaaaaattagctgggcatggtggcacccacctgtagtcccacctacttgggaggctgaggcaggagaatcacttgaacccaggaggcagagattgcagtgagccaagatcgcgccattacactccagcctgggcaacagagagagactccgccccccccccccaaaaaaaacaaaacaaaacaaaacaaaaaaagcagtgccattaggcactagtgccagagtggttgcatgcatctggattccctggaaattcctgggagcgggagtgacagagcccagtcctgtcactgagtgggttcttaagatgaccacggttcctgttttcccacagccctctgtcaagtcttcaccgacgggcagacagcacagttcacatttcagtcacggcactggcttgcccctcttgcttggcagagaaaggacagtgactcccttacctggaaggttgtgctcttatctaacagaaggaaggtgaagaggtgcagagcagaggatgacagccggggggcaacatgacttttgctggatgtgagaaatgccaagtcagtcgctataccgaccttagttcttcagccccacgtcccatttgagacgcatattcctgcattctagggatacacccaactgacctgtttcatggagggaaattagagtttggctttggctgtcagtttctgaaaggaattaaagggtttgctcctcatcctccatgccgtgctataatacaccaaaatgaccacccggcagtttgcagctgaactcagacatcatatagtcagttacatctctctcgtcagataacaaatgtcttggaccccactgtggaggggtaattggaattcagctaccgtgggaactctaccttaattgccatacaggatgacaacaagggagcccaaatagcagaatacatccctgtatcatttttttcttggcttggcagaggtgtgtgtagtgctggtgtattagggttctcgagagggacagaactaataggagagatgtatatataaaggggagtttattaaggagtatttactcacacaatcacaaagtgaggtcttacagtatgttgtctgcaagctgaggagcaaggaagccagtcttgagtcccaaagctgaaggacgtggagtctgatgttcaagggcaggaaacatccagctcgggagaaagatggaggccagaagactaaacccgtctattctctccatgttctgcctgcttttattctggccacactcacagctgattagatggtgcccatccagattgagggtgggtctgcctctcccagtccactgactcaaatgttaatctcctttggcaacaccctcacagacacatccaggaacagtacttcgcatccttcaatccaatcaagttgacactcaatattaaccatcatagctgggttctgtcagttgctctcccaggactttccagggaatacagattagtagagatagaagaagataaggaaagactattgcatggaagagttgccttagtgatgatgaaattggagggaaatatgtaatgctgctgtgttggaatcttccccatgaagaatgctttcccaccttggatctacagagatgtcttttgtaatagggtttggcagaaaaagcaacagactaggagtcaggcggtctctgctttgctatttacatccacctaattcgtagaacccagacccaacctgcaaactactaagtcctggcaaaaccgcagccattagcatgggatccacattcccagtgcatgtttagatggccttctcttcaccctctctgattcctggttaatgttttctttgccaccctgacttatgagtatcaggactcatgagcagcaagaaatagaaaacccagctcagactgactcaggccaaaaagggtatccgttggcttatctaattgtaggcattgctgggtataaggactcctttgatttgattgggactcagtttcttgccatctctcagttctgagttccttttccttgactccactttttagcagggtctttcctcctgatgatgaaatagttgccagagatgctaagcttatatcctctaaagcttcaacttcagtaaaacagagagccaacttctgtttcagcaatgtcagtagtgtgtgtcactagctttggaagggtgattctcctgatttgggactagatcaaatgttccccccagcgaggtgtggtggctcatgcctgtaaacccagcacttttggaggccgaggcagacaggtcacttgaggtcaggagtttgagaccagcctggccaacatggtgataacctatctctactaaaaatacaaaaattagccgggcatagtggtgggcacctgtaattccaggtacttgggaggctgaggcaggagaatcgcttgaacttgggaggaggatgtttcagtgagctgagatcacgccactgtactccagtctgggtgacacggcgagactctgtctccaaaaaaaagtacccccgccccacctctgcaggagaggaagccccactcgaatcacttgggttaaaagtaggggaagggttaatctcaggtgaaaaggaggtagtactgttgcaagaagagggactggatagatgtgggtgacccaaccataactacctactctccctcagctcccaaaacatagctcaagcgttcctcagtagcaggaattttacaaaacactgctgcaagttccaataagaggtatgttgcaaatacctaaaattagctggaatttgtaacgagtttttatttttaaaaataagttagagtggattcagagttatcctggtaaagctttcagtgatggatatgtgagcattttaatacggttggctctatttgtgtaaaactttgaaaattttcacaacaaaaaaggtatcccctaaagaatatcaattttactcatttgttttccaaaacacttttttttatatgggaggtaggttgtcagagaaggggtgctcaggcctgcttgttagactagagaaggcttcctggccaagtgacagctcaggatgtgggaagtagtaacagccaagtgagtgcattttttttttaagagatgggatctcactctgtcacccaggctggagtgcagtggcacaatcacagcttactgcagccttgacttcctagggtcaagccatcttcccacctcagccattctagtagctgggactataggcacaccacaccacctggctaattttttattttttgtagagatggggtcttgctatgttgtccaggctggtcttgagaccagaactcctgacctcaggtgatcctcccacctctgcctcccaaagttctaggattataattatgagccaccacacctgacctgcattttgaatacaatatgagaagggctttgtaaactgtaaagtgccataaaagtattgtaagtatgtggtggaagaatatttttgaaatattaacatgattttcccctcagctttttttcccattcttactgcctttgttttctcctcactcagctaagccaatctatattcattctatcaggaggaagactatgacagcaggagaaagaacaaagaatcttctaaggggcacagaaaagagagagttattaagtcttccccaccaccagactagtaaaaagattccctagactgggagaacagagagagccagaagttctatgcctgaagctttccaatgacaaaataagaattccccatggcaggtgaatgggtaaatgatggaagtgtcctatgcatgaattattatgtagcctttaaaacgaatgcattaaatctatgccagttcatttggagggggcttctggtttacaacaccagcgagatgtagacaaagatgctacaaaattcctttttgtagaacaaatgatgcccagcccccattattaacatagacatttgcatgtttgcatacagttgcatgagcatgggcaaaaagtatgaaaagatacactttgcttcctaacactatttacctggggagagaaaataagtgggaggaatagaaacttaaaaagtatgcacaataaaaaagcatttgtggcaattccatttatgtgatattcatatgtatacatacgtgtgtgaatgcgtatgtgtgtatgaaaagattaccaccaactcaaatggtacagatatgtatgaagaaactcaagataaataatagtaacattttgattattgagtttccttatagttatctaaattgttcaaattattttctcaagcttcatgtattttcccacttttaagcaggcaataacagaaactatcttaaagataacacatttaaatttactgacacacagtaggcacctaataaatagtttaaagaaaataagtataattctcaaaattcaataaagatcttgtcattgtggagacaaaaagaaccacgcttggagagaagccagagatagctgagaagatgctcactctgtcttctccttgaaagaaaagccaacacagatttaagaggtccaaaaatgatagagaggaagagagagagagagaaagattttcaacctgctgcttttcaaccaaaacattgcagcaagggctgcaagccacatacgtggaatatactgagaatttagcatctgatcatgagcaaactcagagacatggatggtccttcctgctacttctttgagtttgcagggcttggaggctgtagcagtgagtggtgctgctgtcctaatgtcctgactataccgggagccactcttcgatcattcttctgtccattcagatgagtagagatgggctgcatgaacggttttatccccaggatcaagtggagcatctggcatggaacagccagccactcagtaagtgctgggtgaatgcataaataagtaagggaatgagtaaatgaagggttgagtatgtgagtgagtgagtgaatgggtgagacaatggatgaatgaataaatttgcaccccagaagaagctctgacacagctttgaattactcctccagatgcgaggggctttgtggagagctgtccatcatccttgcctgcccaaggacaatgacttctcagctttcaccatgcatcctgcagccatggagggaagcaaaattaactggtctccatcagcctccccatcaaacatttgctgagcacccatcatgtgcaaaatattgactaggaactgtgggagatgggaagaattctggaaactcctaactctcaaggaatttgcagggttatcagacagttgccacacaaagacataaaaacatcccctgctaaaataaagaccacgccagatatgtgctgtaggtattcacccctgcaggaactctggggaaaatggggcaggaggagtcacccttggatgtcacaaatggctctccaaaggaaatagaacaacatcgcagcatgaattctgaagccggcccacctgcctgccttgaattacagcttccaccagctgtctggccttggacaaactacttaactctccacatctgtcaaatggggataataatataacaatcccccaatattgtgaggatgaaataagctaatacttaggaaaagcttggaacagtgcttggcacgtcttaagtgtgatatgtgtgagctccttccttgattctcattctgacttgaagaggatttttagaggggagacccagggaacagtggggcagcctagacgggtggaaagtgttatgctggaggcttaacctaacctggttcaaaacctggttctgctatttctaccagtgtgaccttgacttaaactctccaaagctcagttcctcacttataaaatggtaataacaaaaccaatttcattgaaaacgtatgctaacgatgccatgataaataatagttattattaaagagaaacacagtaaagaagttcccagagggaggtgaataaattaagcatgatgacgtgccttgctacttccccatctttctcttcttcccccagatttgttcaaggtctcatcattactggtttgcatttctattttaatcatgttataggtttacagtatttttccccctgcatctttatatgctataatttgggtactatttttacacaacgaagccatttttaaccgagaacagattcaattgtctttcagcatatatcattgtttatcttaattaatgctaaaatattcttagggggaaaaacacatcccacagagtattatgcgaagaaacttagcattcatttttgcctccctcttttctggcatatcaatttataaaggttttagcatcctgttatttcaatgacaataatgcatgctcttaaacgcagacacccatctgtgggaagcaagtcacagggtgtcaacagcagcaaggtgtgtgttgcagtggaggtggaggattgacagctggaagaagaaggggattttgctggtgagaataatgccaagtgaagtcataggctttgtctctgattgatccatggaaacattccttgagtagagctgaatctagctagattccatgcttggagtctttcttagtaaggctactactataagcacagatgatggaaaatggatgatgtttttattcatcatccattctctttccttcaaataagatgccccatgcacctctgagggaatgaccctttacacactcaacctaagttttttgcctctccctccagctctagggtgggcatgtgatatagaactgaccaatcaatatctattatctttctggccacagtgattgggcaagggatagccatgtgacccaatcagagccaagagactcagttttgaggctttagatagaaccactgggaaagagggttctctttctactgggatgctgacctggcaggaatattacccagagctgcctgtgaccatctttactatgaaaaggggagagcttgccaaagaatgaagctgtattatagtctgttctcatgctgctaataaagacatacctgagatggggtaatttataaaggaaagaggtttaatggactcaaagttccacatgtctggggaggcctcacaatcatggcagaaggcaaacgaggagcaaagtcacgtcgtacatggtggaaggcaggagagcgtgtgcagggaaactccccttcataaaactatcagatctcgtgagacttacgagaacaacacaggaaagacccgcccccatgattcatttacctcccactgggtccctcccatgacacatgggaattaagggagctacaattcgagatgagatttaggtggggacacagccaaaccatatcagaagccaatatgaaagaaaacagaactgagagatggaggcagactcttgatgacaactcctggaccctggatcaatttttgtttaaagccagtctgcactctgcatctttgatgtaaaccaatgtatttcctttatttgtttgtttaaactaaattaagtcatttgtaatttaaagagttcagagaggtgccgtgtttcagtagggaactgtaaaaagccaggatattctgtaaattagaagggaataatgtggtgttgaccacatctgggagaatgtgcatctgagggtgtcttgcatgccaaactcacttgtcttcctaatcaagcaatagtttggtaactgagaagttccaagtagcctttaagtcacacaatcatactagaggaactcctaagaacctgggtgacattgtgatataaaatgtggaacttcactaggttatgcaagaacctctgaaaagggttgataggaagggtgtacgttaggtgtgtaaagaactaggtgtgggggaactaactagtacaaaagggatctggtgaatttggattctaccctactcgagatgatgttggagggctctgatcaaagtaggggtttgggggcagaattatgacaagtatctataggaagtcactatcttttattaaaaatttgttgtgaacctgtcctcactcatagttgggaattgaacaatgagaacacatggacacaggaaggggaacatcacactctggggactgttgtggggaggggggagggatagcattaggagatatacctaatgctaaatgacgagttaatgggtgcagcacaccagcatggcacatgtatacatatgtaactaacctgcacatttgtgcacatgtaccctaaaacttaaagtataacaaaaaatttgttgtgaaccagatactgtactaaatgacttacctacactgttgtatttaattctctcaacaacctgatgagttctgtatcttattatatccattttacatgtaagggagctgaggcttagaaagctggagtgacttggtctgccatggctaggatttcagctcatgtctgtatgactcgaaagcatctagtgggtggtaacattggtttgtagacttgaaacaactttggctaatgactggggcacatggaagaggggacagagtccagcttccaaagttagaaggctaccaaaactaaggttttggtcagagattcaacattccaggggcagaccctgatcccaatgggagagtagatttgatagggaaactgaggcaggatcctgggactggagccaacacagggagcattagttgggagggttgttgtgaccagtcaacatacttctgggggcttgtggcaaagaacaaacacagaactccaaatgaattccctgccagagcttgttcagagttggcttgggataggagaatctgaggggagtatgaggctgacagagaaaaaagagagtcttgtggaatcctaagatttaaaaagagaggaagaaaagatgccttttatttattaaacagtgattacgaaatacctaacacatggccacgattagactaggctcttcccatacatgaagctcagagaggtcaagtgagttgttcagggtaacacaggagctgtgcctgggtatgaagctgtatctgctcaaacataaaggtcttttcatggtgccagagtctacatttcccagagtactaagatagtgacttgatcatcagcactaaatatgtgtcgtaaagatagctcacatttacagatattatagctactctgtgccctgcaaggtgctaacgactttacttggattatctcaacttatcccccagacaacctatgacgtttagccaggcatcatcatcatcatcatcatcatcatatcatcgttatcctcatcctcatcctcatcattgttcttgaatgatgaaaattggagctcagaaactcaacctgtgtcaagattacaaagctagcaattctgggtcagaacctgaacccaggcagcccgcactttcgatgtgcccaagcttatatctccacctacaactctgcctcagtttctccctctgtaaaatgaagacagtaataaggcacctcacaaggttattgtgagaacaaaatgaaccgctgcatactaggagcttaacagactggcaaagaaaactccatcaatgttggctttcatcggggctattttaatttttgcatcaccctcttcaaaagggcacttctcgctttcccacggctaagctgccacactcaagtgtgctggaaaaaaaggctgggtagctcacaacgtgcgggggcatcttagtgtaatcctggggtgagagataaaagaagctcgcttgacataacttcataaacccattttaatctaaacattgattttcctttggaacaatccctttccccttgctcacagtcccaccacgcctctaatacagacgtgggtattgataacattattgagataaaacagtcgcctctttcttattccctttattcatcagtcaccccaggcctgtctttgtcttttttcatcctctgctacccagcattattcattggagtgccttcttttccctcaccctccataactcaaggtgaaagttttcagtaatgacaagtagtaaaatatgagagatttaagcaaattcaactggaaataatgtgaaaaaatattattcgctccggacacatgcttctcttttgatcttccttgtccaagatacattttaaaaaaaatactcctttgataacaagaagtgagcaggggctaaaaggaaaccttatgtctttgttgggaaataattagtctgatcgaatcgcttgctttctgatggacaaaggagtctttaaagaaaatcatttgtgttctctgggccccttcaggcagcacagctttccgaggcttgggcttttagatgagagtttggggaatggaaaatttccctgaataagaaatcagagagcttgacctacacagttacctctctcttaacatgacaacaattggcaattactttttgatccaaagtgtgaggatgaatatggaaaggaagggcgaatcattctccttcttctcaagctcattctctctttagacctgcacctgaagctgattttcttttcttttttttttttttccagtcccagcaattcaatataatctatagctggaaatacctatgttagctgcagctgggggaaaaagcagttggcaaattcatgaatcagggcttcttttctttttcgcttgtgaaaggtaacttccgacagcttaagggtgatttggaatgaagcgtgggttggttcctagtgtcagcacattgcctagttgttccagccaggctggctgtaatgaagcgtggacatccatacatagtttcagtgtcagggacaccggtgactctaatgaagagaggaccttaactttgatgcagaatcatgattgtttatagctgtgtggtgaagaatgggctctgaaatccatcgcacttcggtgaaaatgctgtttggtctgcaatgtgaagctgatagcttaatttctctgatactcagtgtctttacctgtaaaatggtgccaatatcaaagtagctgtctggtatagcagggtttcttaatcttggcattatcaacatttggggccaggacattcttcatggtgaggggctgccctgggcattgtagggtgtttagcagcatcgttagcttctacccactagatgccagtagcactctccccccaccccattatgacaacaaaaatcgtctccagacactgccagtgtcccctgggaggcgcaatccctcctccctcccctcaccgaaagccgctgccatggagctattgtgagaatgaaatgaaataatccatacaatgctctcagcactgtttagtagacagtacatagtaaatgctcaatacgaattagttgttactcagacaccaagagggtaacaacaggcgcacagacactggggcctatttgagggtggaggatgagaggagggagaggagcagaaaaaataactattgggtactaggcttagtacctgggtgatgaaatcacaaaccctagtggcacaagtttacctatagaaccaacctgcacatgtacatctgaatctaaaataaaagtttgaaaaatgaataaataactattacttgttactgtattaataaaactgtcaatagaaactcaacacaatcattttttttctcttgaagaatcttatagaatctctggatctttagtgtcccaatttccctgatattggctaggaaacctcagttgccccacctgccacttgtcaaatgttttgtttttggcaaaaccatccagtgctaggagcaggcaagtcaatttccaagtggttctgtgaatgaagggtgtcctctcactttagtcccagggaaatagctaatgcacctgggtttaatacctaggtgatgagttgataggtgcagcaaaccacacaggcacacttctacctatgtaacaaacatacacatcctgcacatgtaccccagaacttaaaaaaaaagttcagaaaggatcaggaaaggagagatcatatccatagcagtagggacagcaacactgaggatctgagtaattagaagtcaaccaaagcttcctcatcctttggggagaaagcaggatgcccagaagaggtaaccgcagttgctccctggggcctggaggtcttgtgtgcatgctggagtgggaacagggaaaggggcaggtggcgaagagcaacagatgcaatcaactttctccatctatgctttagttctagcgacttctaccacttgatggactgcacctaatagtaaccactgtttgaactctatcatggcctgagttgtgtctcctcaaaattcaaatgttgaagccctatttggagataggaaccttaagaaggcaattaaggtgaggccctaatccaatagagctgatgcccttgtaagaagagaaaggcaccagcactctgtttttctccttatgcagaggaaaggctgtgtgaggatggaacaagaaagcagccatctgcaagccaggaagagtgatctcaccagaagttgaatttgctggcaccttgatcttgaacttctagccaccataactggagaaaacaaatgtctgttgtttaaggcccatcctgtggtattttgctatagagatctgagcagaccaatataagtgcttaccaggtgctcggcgtggtcactcatttcgttctcataatgacactttgaggtaggttttacagaagaggaaacaagctcagaaaggttaaaaacatgtccagcgtccacacaaataggaaatgtactgctgggcctgtccatcttcaaaaaaatgaggtccttaaccaccatctcaatgtgggctgtctctatccccacatcaccatttctagaatgttgacattgtacaagtctctatgtcagggatttaaataaattagctcttgcactttgggagaccaagatgggaggatcacttgagaccaagagtttgagaccagcctttccaatatggtgaaacctcgtctctactaaaaatacaagaattagccaggcatggtgatgcacacctgtagtcccagctactcaggaggctgaggcaggagaattgcttgaacccagaaggcggagggtgcagtgagctgagatctcattgctgcactccagcctgggcaacagagctagattccatctcaacacccccatccccaccccccgaagaaaagtacatcagctcttttaaatctctgggtggggaactcttgctgtgagaaatgagctgatatttggtctttagatatcacagaaacagctactgaattttactgtctacaattttaatccaaccaaggattctgagggtgcatgggggtgagggctcagaaagagaagagcccattcaactccaggtcactccaggtgagttcactccaggtcaagagtcagccaatgctattagtggctgcaatttgcttttcagggatctgcttttatgcaaatgaaagcaagaggtctccaactaaggaaggggaatgaacatccctcctctgccctacaattctagtccaagatgtctttctccagctgggggcttagcaacaaattgtatcttcctccttcgtttccttccaaggacaatgaataatcataattcaaagtagagcaaagagcctgcatttacacagtgcacatttccaatgttttttgagattacctgattttaccttcaagtcatcatgggaggcaagtgctttctgacagatgaagtcaagacatagaagtgaggactcttgacctcaacccactgcatttttcccaggtggtgccatttggctggcagtaatgctgtagccacttggcatccatcacaggtaagggcagcagaattagaggcagacagacctaggtttgaatcctgcctctgacccgaaccatctgtctgacattggacacattaacttatctctttgaaaatggtgtagagaaaatgaagatggagatcataatgatctgcaggggtcaaccccatacaatttgaggggatctatggaaagcacagtgcttggcatatatatgatcaatgcttagcagctgtctttgctgttcccaatggacaagaactttctagaatgtataaggtctgtgcctaagcactttctttcacgatccttgtccatgtcatggggtcctctgaaggaccttagaggtcattcttagtttggctggggcttcccttgggtaggaaagataacgtagttctgaaccaggcagtatttaatgagtgttcactcagttcttggccaactactctaatgaccaagagtccacagaatctgttgtttatgaacgccagccttgaagtcagatcaagtcccagctcagcacctactagcatgtgtcccattggacagttgtgagaattcaatgggataaggcatgtgatatgctcagcacactggcacacagtatgatggagctgacacaatcttcccaccagcccctttctccccatttcctcccagtgcagatggacgtaaggagctctgcaagttggttaagtttcccttttacttctctcattccttcactggaggatggctaaggttgcagtgagctgagatcgcgccactgcactccagcctgggtgaaaaaaagatattgggtttgattaggggctacacaagggagagaatgcagtggtggtgggctgtgcaggaaaacctcaactgcttgcaaacagcatgtagttttagctgggcatgatggctcacgcctgtaatcccagcactctggaaggccaaggtaggtggatcacctgaggtcatgagtttgagaccagcctgacaaacatggtgaaaccctgtctccattaaaaatacaaaaattagccgggtgtgggggcacatgcctgtaatcccagctacttggatagttttcctggaatgacccacgttggttcctgtgctcaatgattcttttccaataaggcaatattcatctcgccttattggaaagggattttccatctagttggaagaatctctcctccgtagctacagccctgatggatagaagcagatttagattttcttttgacttttgaaccatttaatgataactaggcccttagacctccctccccacaaccccgttacagtaatgcccatggcataaacatggaatgtggtgtccaggaaactcggattctaacctcaatttttatttttctaatggggctgaaaggcaaggcaatgtctaaaatttatcgcagtttggatattctgcgtttttgtcattcccttgataaccaacgcagaagtcgatcagtcctaagaactaagatgatgaagcactcacactacatcttatatttcatcctctttcctgtctgcttagcgtaagctctgcttctcatcaggaagatttgtgacaagtagtggtaaattattcccaaagctcgcttgacccacggctaacaacatccttcacagtgggtgttgtgctaaacccctattaacctcattagggaggcaccaggttcaagaggctgaagaagagacccggagccagtaaataagacatggggtagctggctgcggtggctcacgcctgtaatcccagcactttgggaagctgaggcgggtggatcacctgaggtcaggagttcgagaccagcctggacaacgtggtgaaacattgtctctactaaaaatacaaaaattagtccagtgtggtggcgcatgcttataatcccagccactcgggaggctgaggcaggagaatcacttgaacccgggaggtggaggttgcagtgagctgagatcacgccactgcactccagcctgggtgacagagtgagactcagtcttacaaaaaaaaaaaaaaagaaaagaaaagaaaagaaagacatggggtttgattaggggcaacatacatgggagagaatgcggtggtggtgggctgggcaagaaaacctcaactgcttacaaacagcatgtagttttggccgggtgcggtggcttatacctgtaatcccagcactctggaaggccaaggtaggtggatcacctgaggtcaggagtttgagaccagcctgaccaacatggtgaaaccctgtctccataaaaaatacaaaaattagccaggtgtgggggcacatgcctgtaatcctagttacttgggaggctgaggcacgagatttgcttgaacccgagaggcagaggttgcagtgagctgaaatcacaccactgcaatcccgcctgggtgacacagtgagactctatctcaaaacaaaaacaaaaaaacagcatgcagtttatatagcattttcacttagcagcctccccttaatgacctccacctggcaactttcatttaatccaaaacttagagtttcaatcccctgtacaacatatgtttcatgggacaggccaggaactcagatgctcttcatagaccaggaaaaaatctccaggttggccactcctgattccctagctcagaacgcacattcaggtgcatctgccatacagagtcattctaagggtgtgctttagttattgctgtcaggtgcatttaccctacagtggcttatgacatggttaagagcaggcatttgaagtcaaatcccattctggctacttgctagctatgaaactgagacctgttctttcttcaacattcatttattcatttcaaaagctagtacagcgatattcctttggtgccgtggatacagtgatgaacagggcatacactatcccctccctgccttcaaagtgtacaatctactggcaaagacagccctgacaaagtgtgacccaagcgaggatatgggaagacccatttttatgagatcatttgcagaagccactactgtggtctggacagggtagaagtcagggaaggcttcccagtggcgctaagcctaagctgaaaatgaaggctgaataggagatggaggaagggaacctttgctgggcggagagaacctcatatatggaggccagagagctagagacagtggagtgccttaaactctaaataaattgagaaaagttcatctggaagtttctactctgtgtgtgtctgcgtgtagtttccttctttcctttttttttttttttggagacggagtctctcactcttgtcctggctggtgtgcagtggcgcgatctcggcctgctgcaacctccacccctgagttcaagcgattctcctacctcagcctcctgagtagctaggactacaggtgcccaccaccacacccggctaattttttgtatttttagtagagacagggtttcactatgttggccaggctgttctcaaactcctgacctcatgatccacccgcctcggcctcccaaagtggtgggattacaggcgtgagccactgcgcccggctgttttttttgtttttgtttttttaattttttcttttagtggagtgtggggtagagagggaaatggtgagagctgggactggagagcaactggagagctagtgagggccgggttatgaaaggggttcagaaccgtattaaggagaatagacctgtatcctcaaagtaatgggagcctcatagacaattttaaagagggaattacatgattgagtttttattttggaaaaatcaactaaattttggagaatggtttgtgtgggaggagaagaagttggaggatagagcagtgacctaaagcgatggccagaaagaaggcttcttgaaggctgagatcttcgtcagttttgtttctttcagcatcccagtttcttggaacagagattggtacataccagacaatcagtaattgcttgttgagtgaccgtggcctagaccagggcagtggctgtagggataaagggattcatgtggatttgagacctaatttgtgggccaagggaaaataatcagtgatgagtagaagggagttaagaaggattctcagtgttctggcttgagcaactgaagggaaaatggtgacattttctgagatgaaaaatccttaaactctttgagcctcagtttcttcatccataaaatgggaccagtagcccacatctcacaagtatgtaaagggagtagcctagtgcctgatacataaggggtaatcagtgcgtcaatgtgtccttcaggctcagatctcctctatagcatgcaaagttccctctataggttatgaagaaagcccacatggacattttcccagggtctccaggtttgaggttcccagagatggtgtcaggagcagcagcaacagccctacaagtggaaatgcatagccaggaaatgaaataaacaactgagattgctaattggagtttattttctaaaaatgaacagcgattctcagcatggcgcagtcacctgcaaagctggtccttaataagctattctggtcgttgtcaacatgaagaatttgattggacagaggagtagattggtggtgaggctttctgtagctaaggagtagttggggtggtgggaggtgggcaataatttagcagaaaggaagtgagtttgtttttaaactcacaatcctccctggggtacaactacttagggtcatttctccagtctcattttctgggaaactggaattgcacctggttatgggcagccagagcattgttgaggctgcagtttcctgtggacaagatgcaaccactggtgttaacaaggcccaggaggtcactcagagccaccgccacctctttctcttccatctactcagtggatggagaccaagcaacaactctctgccatgcaccacagtatgctagtactgaggttaccgagatgcacgagtcacagcccctgccttttgcaagggaaacagaccagcaaacaggcaatcacaatcccataggatgggagtccgtatttatttcctagggttgccataacaaatcaccacaaacttgcatggtggtgcaagtttaacacaaccacagaaatttcgtatctcatatttctggaggctagcagttcaaaataaaggtgccagcaaggctaggctctctctggtggatctagagattcatcattttttgcctcttcatagtttctggtattgctggttatccctggtggttcttggctggtaaaagcatcactccagggctcgcctctgtcatcacatggaattctccctatgtgtctctgtgtttcttctcttcttgtaaggatggcaatgatattggatttagggtataacctcatcttagctcagttacatttgcaaataccctatttccaatgaaggtcacatttaaagataccagaggctaggacttgaacatattttttaggagtcgggggacacaattcagcccacaacaatgtgagtacaagcgtgcctgatgtcctgtcgaatcagattttaccttgttacaagtgttatgggagcaatccctatgatgtgatctgcagttctctctctcccttttcctttttcctttttttttctttttttattttgcctcccttcctttacttcttgatttttttttttttttttgagatggagttttgctcttgttgcccaggctggagtgcaatggtgcaatctcagctcactgtaacctctgcctcctgggttcaagtgagtctcctgcctcagcctcccgagtagctgggattacaggcgtgcactaccacactcaactaattttttgtgtttttagtagagatggggttttaccatgttggtcaggctggtctcgaactcctgacctcaggtgatccacctgcctcggcctctacattgttgggattacaggcgtgagccaccgcatctggcctacttcttgacttctttcttccctttctgtagttttgtcaactcatactaattggtcatctcctgcatattaggcagagttctagacatcagggatggagtgcagagaccaaacagacacagttcctgtctctgagactcacgagttatgggggaaagagacagcagccaaacagtcacataaatacatgtcaaatgacaaccggaacaattggaaggggatcccttctgaatatgcagggtaacagcttgaactgaccttccaggggaacaattctaaggccgtaaagaccagtctccagccatagactgtgtatttccactctgtaagcatcaacatcttctagtccacaagatacaggaagaggagagatagaaggtcattgatttacttgggtccatgtatttgaaaccctctgcttgagaagtaggagaatagggaatgaggataaccaaaggttaagtcataagcaaaacaacagcaggtgcagccagttctaggcaagactgggcagcatacaggccacatcctcactctgaaataacaacatggaaatttccatttcagcctctgattgaccacaggccaagtctccacttcagcctctgattggtcatgagccatctccactttagcctctgattggttcttgggccaatccttcataggatataaccaactggaggcctctaaagggcgccaagtgggtgttaccaaactcttttagcttaataagaaccctaaacaacattataatgggagcgtttgagctgcttgttcaagcctgctcccactctgtagagtatacttttgcttcaataaatctgtgctttcattgttttgtttttttttgttgttgttgctttgtttgtatgttttgtttgattctttgttcagtgcaccaagaacctggacaactcacagtcaagcatttccatcccgtaacagttggagaataagcctgagtgacgggccttccatttagcaggtgaatctcagctgctacgtaaatcgtcaaagccagaacttggaatgtgaatatagccatgagagtgcctcagcaaggagccattatgaggtactgataaactgaccaccctataaaaaccaagggggccaggaagttataaatggttcagcagcatccagggaagtgggaaacactcacaaacctgagattatctggggggactcttgagcagcgttggggaagtcacaaccagtggtgagaggctacaaaggcaaggagtacgtggtgtttgagggtaaatgataggctggacctggtcagggtggggaaagggatttcctgggaagcgacgcttgtgctctgtttcccaggtccatgaagacaaagctgtcaaaaaataaaaatataaggcttcccatccacacccatgtaatactgtgaacggatctcagagtttggtgtcaaaactcaccaaaacatacacttaaatgggtgccttttatcatatgtaagtgatatctcaataaagtgaattttgaagatgctggtgatagccctctttgtttttgttttgttttgtttgcttgtttttgttatttcaaaagaaggtcttgctctgttatcttggctcactgcagccttgacctccggggctcaagcgatcctcttaccttagcctcccaaatagttggggctatggatgcataccaccatgctcagctaattgctttttaattttttgtagagacaaggtcttgctatgtttcccaggctggtctcatactcctggactcaagcaatcctcccagcttggtttcccaaagtgctgggattacaggcatgagccaccatgcacagcccctctttttttaaattctgggtgtcaaagccatggtagaagcctttctaattttgctcaagagtcattggatcctgtattatataatgtcagagcctggagagaatcccaagacaattgggatcaaacacatcattttatacaggaggtgactgagtttcaggagagacagcaaggtcatagtcacagcagtcagaaggatgcgccatagattggaaaaatccagaaggtgggagatgggtggagtgacatgctcttagacaatctagcccatgtgctgaggtcagagaagttagatttgaggtccttcagctagtcagattttggccctaaatttcctggccatccacttccttctgtccttaacatgttctgtgaacactcagtcactgctacagtcatacacagattgcatttattttcatatctctttgcaaagcttcttctgcacggggtgtcttgatgtgttcgatgatctgggtctatttaggatcagctcagactcggaaaccggggtggggccaacatcacgaaatggaagaaattataagccaggcatcatagtctggagcagaggtcttcaaacattggtatgtatcaaaattaaagtgccaatccctgggatccacatccagagattctgatttactaggccttgggggtgtctgggaatctgcattgataacccacaatgcaggtgattctgatggaggtggttcaaggacgagagtttgagagtccctgtcctctagcaacctctggattaaacatgggagaaaacaaatagacctgggctgttgactgaccaatgaactttcaaggtaacccgcattcaaaatattctgtatttttcaaaggatggtaatggaaaagaaacaatgacaacaaaagcctgtcttgaacacatacttatttgtggcagttttcagaagcgtattattttctagtgatggagggattttttaaaattctgctaagccttcttttgagtcactctcttgagatatatttcacataccatacaattcaaccatttaaagtgtacaattcagtggttccagtatattcagagttgtgtaaccatcatcatcaattttagaacattttctcctccctccccaagtcctactcccattagcagtcactccccatttcctccgaccccctccacccctaggcaaccactaatctactttctgtctctctagatttgcctattctggacatttcatataaatgaaagaaaatgacacaggttctttcgtgagtgggttcttttgcctagcatgttttcaaggttcattcatgctatagcatgtatcatatcactatttcattttgtaagttaccaagtagtattcctgatgatggattttaaaatggaacttctctcttttcacaagttgaacagctatctttcctctagaataacattttcacaagtggaacatctattttccttctagaacaagaggctttgtagcagataggaatgtcagatgcactgcaaagacttaagaatcttattcaaggcccaagtgacctttccagcctcatctccgtcaattttgcacttccttccatgacgttctagccacacaagacacctctggggtctcccctactggcctctggtcaaaatagcatggcttcttgtctgtgcagtgaatgcctcccctaattctgaactcaagcatctccttgcctggacctttctctcatttttgcccttgatcttgattgtaggtcttttcattttgtgcaatgatgggtgaagtcaccactctttagactggtgacttctctaacagaggaactgaattttcttaatttttgtattctcagtgcctaactcgttcttggcaagtatggggtacttggttaatatttgttgaatgagtgaacgaatgaatgaacgagtaaatgaaagctacagaagccagcatatatagaatgaaagtcgtttttccctggaagttttaacatagtcattttaattcctcctgtttgaaatgacttgtttgcaaaagagtaaaaatgacaatttaaagaatattaaactgcataagcatgaaaaacaatctgctaacagtggttatctctggggaagagttaagaagagctggggggtgttttcactttttctttcattagagacttcaaaagaagaaaagtggtgtaaaaatgggtgttgtttttcttttatggtttttggggatttttaaacataaaaattataaaaaagtaaataaacaataagaagcagagaaaaggaatgtctacacattgttggtgggaatgtaaaatagcacagccaccatggaaaacagtatggatgttcctcagaaaattaaaaacagaactactatatgattcatatgaaatttctatctcagtttaagccattgctagtttgggtctctgttacttacagcggaacctaattctaacaaacacaaatgctttagactcggatctgagtaccaggctggctctgggtgacttgtggcaaatcacttatcccttctgtactcagtttcttcatctgttaaaggagaatgaaaaaaacttacatcatgggaccactgtgaagtttaaaaagcacagtgcctggcacagcaaggacatttttatttattatttatttatttattttttgagaaggagtctcgctctgtcgcccaggctggagtgcagtggcatgatcttggctcactgcaagctccgcctcccgggttcacgccattctcctgtctcagcctcccgagtagctgggactacaggtgcccgccaccgcgcccagctaattttttgtatttttagtagagacggggtttcaccatgttacccaggattgtctcgatttcctgacctcgggatccgcccgcctcggcctcccaaagtgctgggattacaggcgtgagccaccgcgcccggccgcaaggacatttaataaatgacagctcttgccattgttattagcaataatgataacagcaataaacagaaaaatgacaaatcaacgtatatgaaggtcccttttatctgtaacagactttgaatccaatttgatttatagcctgtctgcttatgctgggtggcttaacatattgattatttgaaaaccgtgtggcttagccctagaatggaggctcatttaataaactccacttattgggtgattatgcagaaggcagctgcaatgacctccaggacagagaagcctgatgataatagtagctaccatttattgagcccttactatgagctaccacttagtctaacacaatcccatgagaccgtataattcccgcccccccaccccgcccccctcccccggccccgccgccattccacagatgagaaaatgaggcacagatagcttaaatgctttaaatagctagtaagtggcttagtcaagattcagacccaggttttctgaaccaaagttagtgagcttttcattagactagttgctgctcaagctacaaataatatggtgtaaaaaaaaaaaaaagcggggggtggggcgcgggggggtgggcttggcatggtggctcatgcctgtaatctcagcactttgggaggccgaggtgggcggatcacttgaggtcaggaattcgagaccctctggccaacatggtgaaaccctgtctctactaaaaatacaaaaactagccgggcatagtggcaggcacctgtaatcgcagctactcaggaggctgaggcaggagaatcccagtttcaacctgggaggcggaggtagcagtgagccgagatcacaccactgcactccagcctgggcgacagagtgagactccatctcaaaaaaaaaaaaaaaaaaaaaaaaaaaaaaaaaaaaaaaggaggaagaagggagataacaaaagggtattggggctttaaagaagggtcagcagttctccaattttcacatttgacgactcatttaattccccaatgagtcctcaaagtcttggaatgaagtatggtaacctcttgctgcagtcactcatgccagggagttctgtgaaatctggggaggggttacctccagtacccaaggatgctgagcaagggactatcagttgtccctctatatccaatcttccttcttccaaagtaaaatgatttttcatggagcatatattaattgttgcctagaatcaagactatgcttcccatccttgcttgcagcaaagtgtggccatgtgtctaagttttggccaatgagatataagtaggaagtattatgtacaactttgggtttgtttctttaaaaggaatgggtatgctcttctttgcttttccctttctgctggttggattgcagatgtaatggctggggcagctgtcttggcaatgagatggacatggaatttgcagtagaagaaacagacagaaggagctcgggtctatgatgctgtcataaaccataccagctttcaactaccttactagacttttcgtgacagggagaaaaaattttctaagtttaagcgattgctaatttgagtctctgtcacttacagttgaacctaattctaacaaacacagatgctaccctgccattcattaccctatcctccctttcagtggcccccaatttctttttgggggaattctgtcaccaaattagatgccttttaaaattgacacattgtattgtacatatttgtggggtataatttgatattttgatgcatatgtattgtataatgatgaaatcagggtatttagtgtgtcaatcaccttgtgcatttatcatttctttgtggtgaggacaattacaagcctctcttccagctatttggtaatctacaaaataccttacttttaattatccttgcccaactgtgcaaaggaacaccagactcatttctcctatctaatgtaactttgtaccagttgatcaacctcgccctatcatcccctctcgcattccctccccagtctctattaaccattgttctattctttgcttctataatagcgtctctgttttttttttagattccacatatgagtgagatcatatggtatttgttttttcatggctggcttatttcacttaacatgatgttctccagatccatgttgtcaaaaaattacaaaatttcattcttttttatggttcaatagtattaaatagtgtatatatatcagattttctttatccattcatctactgtaggacacttgggtggatttcatatattggttattgtaatagtgctgcaataaatatgggagtgtaggtatcttttcaacatgctaatttcatttcctttggatagatactccatagtaggatggctgaatcatatagtagttctgtttttaattttctgaaggaacatccatactgttttccatagtggctgtactactttacattcccaccaacaatgtgtagacgttcctttttctgtgcatctcaccaacatttgtttttatctgtctttttgataatatctagtctaactggagtgaggtgatatctcactgcagttttgattgccatttccccaattattagtgatgttgagcatcttttcatgtaactgctagtcatttccatgtttcctttggagaaatgtctcataaggtcttctgcccattttaaaataaagttttttgttattgttgttgttgagttgtttaagttccttatgtattctggatattagtgtcagatgtctaatttgcaaatattttctcccattctgtaggttgtttcttcactctgtttattgtttcctttgatgtgctgaagctttttattttgatgtaatcccatctgtctacttttccttttgttgcctgtgcttttgaggtcttattaaaaattatttgcccagcccaatgtcataaagcatttccccgtatgttttcttctggtagtttcataggtttgggttttacatttaggcctttaatccattttgaattcatttttgtatatggtgtgaggaaggggtctagtctcattattttacatgtgaatatccaattttccttgcaacatttgttgaagagatggtctttttcccagtgtgtgttcttggtaactttgctgaaaatcagttggctgtaggcgcacgaatttgtttctgagttctctgttctgtttcattggtctatgcatctgtttttgtgcctgtaacaggctgttttggttactatagctttgtagtgtattttgaagttgagtagtgtgatgtctccagctttgttctttttgctcaggattgctttggctatttgtagtcttttgtggttccatatgaattttaggattgatttttctatgtttgtgaaaaatgtcactgttcttttgatagggattatattaaatctgtagatcactttaggtagtatggtgattttaacaatattaattcttccaatacttggacattgtactttttgtgcaggaatttaagaaaaattgttttaaaaattaaaaaacccaatacttggacatgggatgtctttccatttatttgtgccttaattgattttttcatcaatattttatagtttcagtgtggagatctttcatctccttggttaagtttattcctaggtatcttacatttttgtagctatgatatgtgagtttttttatttctttttcagatagtttgctgttagcatatagaaatgctactaatttttatgtattgattttgtatcttgcaaatttgctgaattcattgatcagctataataattttttggtggagtctttagggttttctgtatataagatcatgttgtctgcaaacaggaacaatttgacttcatgtttttcaatttgcatgatttctatttttttttcttgcctaattgctctggctaggacttctagtactatattgaataggattgatgaaaggaatatctttgtcttgttcctgatcttagataaaaagttttcagcttttcctgttcaatatgttcttagctgtgagtttgtaatatctggcctttatggtgtggaggtacataccttctgtaacaaatgtgttggcagttgttaccataaagaaatgttgaaagttgtcaaatgctctttctgcatctgctgaagtgatcatatggtttctgtctttttgttaatatggcatatcatgtttattaacttgcatatgctgaatcattcttacatccctgggataaatcccacttagtcacagtgaatgatctttttaattttctgttgaatttggtttgataacatcttgttgagaatttttgcatctgtatttaccaaggatactggcctgtagttttcctttttgttcttgtgtctaccttatattgcaaccagggtaatgctagcctcaataggtcctgggcttttttccaatggcagacattttattattgattccatttcctcactcagtattgatctgtttagattttctatttctttataatttaatcttggtaggttgtatgtgtccaggaatttatctatttcttctatgccctcaacttctttgatatatagttgttcataatagcctctatgatcctttgtatttctgtaatattagttgtaatgtctccatttccatctctgattttatttatttggatattttctcttttttttttaagttagtctcactaaggatttgttgattttgattatcttttcaaaaagccaactcttcttttgttaatttttttgagttttcttttgttctccacttcatttatttttgctctgagacttattatttccttccttctaccattttgggtttagttcttagttttttagatcctggaagtgcatggttacattctttattagaaatctaataaggatttattagatagatagatagatatattaggtgtttattgctatgaaattccatctcaggactgcttttgctgtattccaaaagttttggtatgatgtgtttccatttttatttatctcaaataatttttaaattttccttttagtttcttcattgatgtattggttatttaggagcacgttgtttaatttttcacgtatttgtaaggtttccaaggtactcttgttgttgatttctagttttatactatcatggtccaaaatgatacatgatataatctctgtcttcttaaatttgttaagacctgttttgtggtctaacatatgatttattctggagaatgttccatgtgcaattgggaagaatgagtatactgtaactgtttaatggaatattctgtaaatgtctgttaggtccatttggtctatagtgttgtttaagtccaaagtttctttgttgattttctgtctgggtaatctcttcattattaaaactgaggtgtaaagtcccctactattattgtattgcagtctgtctctctttagatctaataatatttgctttacatatttgggtgcttcactgttgggtgcatatatatttatacttgtgatatcatcttgttgaattaatctgtctatcattatataatggccttctttatttctttttattgtttttgacttaaagtctattttatctgataaaagtatagtcactcctgctcacttttggtttctgtttgcattttttctatccctcactttcagtctgtctgtaatgttggggtaggtctcttgcaggcaacatataattagttcttgttttttaaaatctattcagccactgtatatcttttaattgcagcatttaattcatttacattaaagattgttattgataagtaaggacttactcctgccattttgttgataattttctggttgttttatggatcttttgtgcttttatttctctcttgttttcctctgtggtgtggtgattttctgtggcactaagctttgttttctttttctttctcatttgtgtatctactgtaatgtgtttctttgtggttaccatggggctaaaataaagagtcttatagttataataggctattttaagctgataacaacttaattttggtcacataaaaatcctccagagggccaggcacggtggcttacacctgtaattccagcactttgggaggccaatgtgggcagattgagagcagcctgaccaatatggtaaaaccccatctctactaaaaataaaaaaattagctgggcatggtggtgtacacctgtaatcccagctactcaggaggctgaggcaggagaatcacttgaacctgggaggtggatgttgcagtgagccaagattgcaccactgtactctgtcctgggtgacagagtgagaccctgtctccaaaaaaaaaaaagaatcctccagacttcatacacccacacacacacacacacacacacacacacacacacacacacacaatttgtatgttgttagccttaatgtacatgttggtcttttgtgtgttccttagccactaattgtagttgttcacgtttttgacctttttgactttaaaccatcatactagaggatttaaagatttacacagcaccattacagcattggggtattctgagtatgagtatgggtttacctatactggtgagttttatactttcatatgttttcataatagtaattatcatccttttgtttccaattgtagtactctcttaagcattttttttgtaacacctgtctatttgtgatgaattctctcagtttttgcttatctgggaaggtctctacttctcatttatttctaaaggagagctttgcaggatatacttcacttaatggtgtctcataagtcttgtaggcttcttcattctttttaacttttttttctctgactgggttatttctaaacacctgtcttcaagtttagaaattctttcttctgcttgatctagtgtgttgttgaagccttcagttatttttatttcattcattgaattcttcagttccaagatttttttcctctatttttattgatacacaatatttacatatttatagggtatgtgtggtattttgataattgaatacagtgtgtaataaccaattcaggatatttaatatacccattaccttaaacatttattatttctttgtattgggaacatttcaaattcttcagctccaagattctgttccctctttttttatcgattaataccatttgtaaatatttacgggatatgcagtattttgataaattcatacaatgtgtagtgatcaattcaaggtatttaggatatccatcaccttaaacacttcttatctctttgtgttggggacatttcaaatcttctagctacttttaaatatataatatatatacaatattttgaatatacaatatattgttaactatagtcactctactgttctatcaaacactagaacttatttcttctatgtaactgtatttttgtacccattaaccaacctttcttcacctacctcccaccctttctggcctctggtaactatcattctactctctccctccacaaaattaacatttcaagctctcacatatagtgagaaaatgtgatatttgtttttctgtacctagcttaattcacttaacataatgaccattggtttcatccatgttgctgtaaataatagaatttcattctttttatggctgaatagtattccattgtgtatacataccacattttctttacctaatcatccattgttcaacactttggttgattccatatcttgactattataaatggtgctgcaataaacatgagggtggaggtaaccctttgatatactgattttcttttatttggataaatacccagtagtgggactgctggatcaaatggtagttctattcattttttgagaaacatccatacagttttccataatgaatatgttaatttacattctcacccacagagtaaatttccttttctctgtctctgtaccagcatttgttgtctttttttgtctttttgataaaagcaatactaactggggtaagatgatacctcactgtggttttgatttgcatttccctgatgattagtgatgctgaacattttttcctatacccattggccatttgtatgtcttcttttaggaaatgtctattcagatctttttgctcatttttaaatgggattatttgtttcagctccaagatttctgtttcgttctttcttttttgagacagggtctcactttgttgcccaggcttgaatgcagtggtgcaatcatggctcactgcaacctcaatctttagggctcaagcgatcctcccacctcagcatcctgagtagctgggactacaggtgtgcatcactacacccaattaattaaaattttttttaatagagatattgtttcactctgttgcccaatttggtcttgaactcctgaccacatgtggtcctcctgcctcagcctctcaatgtgttgggattacaggcataagccactgcacccagccctggttcttttaaaacatctatttctttgttaaattcctcattcagatcataatttttttgttttattgaattatttgtattatttggtatattcttgaatttctttaagattattattttgaattccttttcaggcatttcataaatatccttttctttggcgtctgttactggaggcttattgtttctttgagggtgtcacgtttatttcctttttcttgtgtccctatgttgatatctacacactttgtggaacagttacttttttcaattttatggaataacttttatagaatgaggcttttccctgtagaagggccctagggtatcagttgggaatggtgcactggttttggttctaagtggactgagtcatatgatctccatacagattatttagctataatctttgtctgcaatgtctgcaattgtgtcaggggccttggctatgggagtttgtgacaatggtaacataatgtttctggggcctagggcatagaggtggttgtcgggccaggtatctgcaggtgtggtgggttgacaggctgtgtagtgggctctcttggagagtgggcctaccactgggctggctctcagggtaggtatgggtgtagcatgccaggtggctgtgtggggctttctttgtgcgatgggaccacctctgagccagctcttggtctgggagtaggctggctgactgggcagggcagtagccccaatttctattagtggtttcatgcagttctagaaagtcttcacagggtggagcatatgacctaggataaaccaatcataacattttattccctctgctacagtgagtgtttctgggacaggtttgtgacctaagcttgcccagtcagaaggaatcttaggatacttgcagagattgctgagtcaaagacatgctcttttgctatggaaagtatagcatgtgcatgtgaaacttggaactgtgaatatcatcttgctgtgatgaaggaaacctggctgagaatgaagctgacataaggaagtaaaaaaaaaaaggtacaatgatagacaaacagaacgagagtcttgatcaaattatgcctaaaatctgttaccttctgtgttcttcatatttgtgaaccaatatgttgcctatattgtttgctattactttttggcccttatattctaagtcaggtttgggatggattttcttatttgcagccaattatatcctaattgatagagatgtcctgatgtgttttggttctgtgtccccacgaaaatctcatctccaattgtagtccccatgtgtcaaagtggggaggtgattggattatgggtacggtttcccacatgttgttcttgtgatagtgagtgctcacgagatcatctgatggtttaaaagtgtggcacttccctcttcactctcttcctcctgccactatgtaagacatgccttgtttccccttcatcttccgccataattgaaagtttcctgaggcctctccacaccatgaggaactgtgagtcaattaaacctcttttctttataaattacccagtctcagatagttctttatagcagtgtggaaatgaactaatacatgtcccttcaccttctaccacatatagaaccaacaacaacaaaaagaggaaagtactttgttagctcttctgaaggaagatagagttacagattgaatcagagatatttcctctgtgatccttccctgatgtccccagttctgggcaaagagccctccttgatattcccatagctccttttcattctcatctcttataggaaagggagtctttagcataatacatcattgcaattatgctatgagagccaatcagtatcagcaagaagtttgcttatctagtgtctagttcattctgatgaagttaagagaattaccaagaagaaaggtatctgccatttttctttcaggatgaaggcaggaataacaaaaccatgcttttgaccatgtagggagctgaaaggatggagtcaaggccttgaggagacagcagagaggcaactaagagaagatggcaggcagccagaagaaggcacaatcccaggtacccatttgagggaatccaatgggggaaagtaaagaaacctggacgttttaagtgtggtgatcagattatgctctttctggctaaggactaggacaaggccatccaagtgcagaacaaaatggtgggtttgcatttgtttgctgtcaatctcccctgtcaggtcaactccacgaggacaaggatgataatggcttggccaccattatctccccacagcacagcacaatgcctgggacatgaaagatacgttacaaatatatgtgggatggatggatggatggttggttggtaactctcagtttatatctttgggctgagtattatagttaagaacacagtttcccagagtgactcagttaaagttgagcttcttttatgcaaactctccttctctgtctttcactgaatttcactgacagaccatgaaaactcagaacagaaagggataatgtcgaggcgaatcgtataatgtcaaggcaaatcctgtctcccatctagaggccagggaaggaaattaatcactttgctaaagtctggaattctagttcctctgtctgatggttgatttaaggtcaacctctgcttgacttaaggtcaacctctgcttgacttaaggtcatggtgtattattttttaacatcattatgggctacactcatgaaaatgcctaaacataagagaaagatgacaccttgttctcttgctccacatgtacatatatctgacctctattcaacattcatttaaactgtgattcaatgagcatctactatgtgccatgcactggactcagccttggggacagaatgaagaataagacacagcctctattcttacctagtttataatctagtgggggatgacaagccagtgatgataatacagcacaagatgcagagaggcagaggttgcagtagggacccacataggaacattgaagtcagctggtgggattgaggagcacttcctggaagaagttttgcttaagctaagcacatggaaaagcaccagccaggtgaaacggttacaaaggagaggaatgtttcaggaggaaaatgggagtggtgattggagggtgatggcaccagagtgaaaagctggggtcaagcattttagggccttctaggtcatgcttagcatttcagacatcctaagagcagtgtgtgctggagtcactgggaagttttaatatgggaataatatagggatataggatatagggatataggaataatatagaaagttttaatatgggaatttaatataggaagtttaatatgggattaataatatagatataacctatagaaacttcctctggggcagtgtggaagggagattggagggggtcaaggttggaaatgaggacaccagtttggtggctattttaacataagcacatgcactcactagggcccaagcatatgtactcactctcttgctctctctccctccctccctctctccctccctccctccctctctccctctctctccctctctccctctctccctctctctgcctctttccttctctctccctctctccctctctctccctctctcttcctctctccctctctctccctctccctctctccttctgtctctctttctctctcacacacacacactcatacacacacacacacacacacacacacacacacacacaccaaagatatatgcaagcagcaccaaagtatgcccaccactggggctggaaaacaatgtcttaggctgctccatttcctaatgccttaattttctcatctgtagaatgggaacagctgcaactgtccctcggtgtctcccaggattgctcagagagtggaaatgtcatgtggtgaaagcctttacagctcagtgtggataagtgcaaagggctgtttattcctggtcccttttcatttcatccagtccttcaatccccagcatctgaagcatctctgggaactgcatatggaataagacattctggatgacagcagatcttaagaaagtcaggtttagattagatttccactcaatctcaaagttgaaattagagtaggggaattgaggtcttacctctagacactataactgagaaattacaaaattggctggagactcccaggcaagggtaggaagccctctggcttgggactcttttgaagggatgattccactgattggacagtgttcacactcttggctgtggagtacctgtgtgagtctcctagggcttcttaacaaattgacacagactgggtagctgaaacaacaaaaatgtatttctcattctggaggcgtctctctgtgacgtctgagatcaaggtagtagcaggatcggttccttctgaggctgccctacttagctgtcatctcgctgtgttctcacatggtgttccctctgagtacatctgtgtcctaagttcctcttattataaggacactagtcatagtgtccaccctagtgacctcatttttacttatttacctctttaaagaactcatctcaaatacagtcacatgtgaggtgctaggggaattttggcagaagtgggaaacaaaattcagcccacagtaattcccaaatcgtctatttgggtagtggatataaacaaacagtgaggaaatcccaagactgtacaaatttctgctgaagtttatcctccaacgaagggtcctcaattgaatagatttgctgtcatctcagttgtggcagcatccatattttcctgttctttatctcagctctgaggtgctgctgcagaaaggtgctggtctacattcagttctctctttctttaccactttgcagaacaagttttgctatggcaaccactggctgggaagagataacccagggggtgcgagggtcagctcatgttcttctctcctcatttctaggacagctctgttgtgcttcagctgctgtgtaaatccccaaagaggagttttttgctaataattgtgtgtgtgtgtgtgtgtatgtgtgtgtgcgtacctgcatgcatgcatgtgcatgtacgtgcacacgtgtgtgtgtgtgtgtgcgtgtgtctgggcaaagtggtaccttcaagaaagtagccaaatggaagataggatcaccctgaagagggaagccattcactcattgaccaatgggtcacacttggattttctgtctcaggccaacccacattctagtgactgtgcagcccttggcagttttcaactggctcctcctgcctacccagcagatgggaataatactctgcagacttcaaatcctcttgattctctctcctccaggttttgaaggcagattttatctattgtgcctcttgggctttggtgtctgggccattcacagctacccacctagagacccctcagatgtgtcagaagtggaagtttgtcatgggaagaggaggcagtaatgtgaaagcaatgtgaatttttgctattcgaaggggcacatgactcactgagtcatctgcctgaaagccatcttcagtgtcccctgggccttgaagacgtgggaggcagtgtttgtggatgagaaaggggacattcggagcagagatctgttcaagtctcctggcacaactcaggtcctccaccttggagtctgtcttgggtggtcccaagcatcataaatcctctggaatctgccctgaacacctggatttcctgctagggtcttcagtttgcccagtgatgtgtccatggccagctttgtgcaaagtttgctttccagctcagttgctctgctgcagtttaccaaacttgctagtggacagacacagccttgagcagtccctgtggcttctcggggcatctgtcaaagatgtgcacacagaattcaacaaagttccggttcctcccttgggaggataataattttgtgtgtttgtatatgtgcatgcatatgtgtgtgtgtgcatgcgtgcattcatgcatgcatgtgcatgtgtgtgtgtgtgtgtgtgtgtgtgtgtgcgcgtgtgtggctgggcaaagtgataccttcaggaaagtagccaaatggaagataggatcaccctgaagagaagcctttcattcattgaccttatcctcaggaagccagacgtggtacccacagaggccaatttagatctccggctgtttctctacttccctgttggccctatttgtatatttctagcatgccttttctttatttgttcattcactcattccttcattccacaaatacctattgagcaccagtgatgtgctaagtatggcttaaatttaccctgggaacacagaagtgaaatatacaaatctcctgcccttgggtgcttatattttagtgtgagagggtgggtgagtggatggagggaggtaggtctttgcacttgcgttttcatggattataacaaattttcacagcacttttaattccatgataatctctaactggaaaagcaatcccctcaatacacacctcccaccactttatcctgaatctctgtcctggattgtgaagggatgtcaggcatggcaatatgcttttatgcattttccttttgcttaactcagggctttttaacccattctgtgctctggactcctttggtggtcctatggacccctcctcagaatactctttttaaatgaataacaaaatatgtaaggttatgaagaaaaccaatattttgaaatgcagttctgaaaatctttttaaaagttgtggtattataacttttgtgcccttttattaacacattaaagaacatgatttagcagtgggtttcataacaactgtgatttcaaagtactgatgagcataaatgatattttgaaatatctgtaacacctgcaacgtgttatgaaaatatccctgatttctattggtgacaaagtcctaggtactgcaaatagtaatgtggtttgttgtcactgtataaatctgctaggtctgccattacaaagtcccacaaactgggggacttaaacagcagaaatgtactggtgtgtgtgtgtgtgtcttggcaaagtgataccttcaagaaagcagccagatggaagataggattacatttcaacagaaatgtaagacagtacatttctgtggtttaagcctcccagtttgtgagactagcccaactctgttactagggtcttgcttttaacctaaaggatgtttcctcaattgtattcaagtacaaacagaaaggtactttgagttctggaggctcaaaatccaagatcaaagtgttggcagggctatgttcccactgtaggcactagaaaatggccaagataatacaacaatctacacatacacctcacacataagaaagagaggtaggcattgtgtttttgagaaacaaaaggctccaactagcccaactctggcactagaggcttacttttttcttgatagcctactacatacctccctcactctcagttctctgacaaacaactatagcaacctcaagtgacccaatcttctaacactgaaatcacctaaggatattatgcaactctaggaatacatggtgaagggaaactacctccatttttaatctaaaagccaaatgtcattatgtcaccccctggcactacaccttgaccttctcattggtttcaaaaatccttaaggtagctttcaaggttccttatgactggtccttgcccacctccctggcctcatcccactcctcattaagccccaagatggtccagccacctgccttctcacaggccattgagcacacccatcttctttctgcctctggctttagcacgtgccatttgttctgctgtggttcagaagctttaaggttttctgaaagatgtcaggatgatatggttttgctgtgtcctcgcccaaatctcatcttgaattgtagtttccataatccccacatgtcatgggagggacccagtgggaggtaattcaatcatgaaagcgggtttgtcccatgctgttcttgtgatagtgaataagtctcatgagatctgatggttttataaagagcagttctccttcacacaggctcttgcctgctgccatgtaagatgtgcctttgctcctccttcaccttctgccatgattgtgaggcctccccagtcatgtggaattgtgaatccattaaacctctttttctttataaattaccctgtcttaagtatttcttcgtagcatatgaaaatggactaacacacaagggaatgcacttttctggcctctgaattagcaaagggaaagacggtgtaaaacccaagagtttacagtcctgaggaatgcactttgcatatgagtgagagtccagttcatctaaagcattccatttttgaatggagctatcagttcctgggcttaaaacttaagttctgatttacgtctctgtatgtgtttgtgtgttttgtatgtggtttttggtgaaaataatttcttacaggcttggaataatgagctccctgaatgtgcaagctttggaaatagtaatctacctgtgctaggtaaactgtgtctgaaatgttacctgttgagacaaaaatattcctgggaggtgtgattggatgtgttctgtgtgtgcaaggggtggtgtgtgtgtgtgagtgtgtgtgtgtgtctgtgtatgtgtgtatgtgggggggggggcagtgaggaagagagagggagagaccttagcccaaaggagtgtttcctgaattgtattcatttgttcactgcctttaagatttttgctatattcaactaccatctgtacttactttcttacagggatacattttcatgttttctttaaattgacccattttttgtaaacgtagcttcaacctgaaaagactatccaacaagccacagacttggaggcaataattgaaaacacacatctaagaaaggtctggtatctaaaatatatacaaagaactcttaaaatccagttataagaaaacaaagaacccaaattaaaaataggaaaaatacctgaacagacacctcaccaaagatatacagatggcaaattagcatatgaaaagatactcaacatcatatatcattggagaattgcaaattacaataacagtgagataccacgtcacacctattagaatggctataatccaaaacatggacaatgccaaatgccgaagagaatttggagcaacaggaactctcatttactgctggtgggagtgcaaaatggtacagccactttgcaagacagtttgacactttcttacaaaactaacatactcttaccatatgattcagcaatctcactccttggtatttacccacgtgagttgaaaagttatgtccaaacaaaaacctgcatataaatgtttatagcagctttattcataactgccaaaacttggtgctatgatataaatgttttttatccccgaaatttcatatgttgaaatcctagttccccaaagtgaaaggggtggagctttggggaggtgactagatcatgagggcggagccctcatgagtgggattagtgctcttatagaaaggcccaagggagcttgtttgtcccttacaccaagtgaggatgcagccagaaggtgctgtctttgaggaatgggcacttatcagacactgaagccagtgctttgatcttgcacctcccagtctctacaactgtgggaaatcaatatttgttgcttataagccacccagtttatggtatttttgttatagcagccaaagcagactaagatacttggaacaaaccaagatgtccccttcagtaataggtgaatgcatgcctatggtacacccagacaatggaatattatccagcaataaaagaaatgagctaacaagctgtgaaaagacatggaggaatcataaatgcatattgataggtgaaagaagccaatctgaaaaaggtatgtctagtatgattccggctatagcacattctggaaaaggcaaaactatgggggcaggtaaaagattagtggttgctgggcgtgggtggatggagggatgagtaggtggagcacagaggatgtttcgggcagtgaaactgctctatataatactgtaatggtagatacatgtcgtcaacatttgtcaaaattcttagaatgtacaacaccaagagcgaaccgagatgtaaactattcactttagttaatacgaatgtgtccatattggctcattgattataacgattactactacactaacaattagtactacactaatgcaaaatataaataataggggaaactatgaggggaagcagaagaggatatatgggaattctttgttctttccagtttttctgtaaaataaaattgctcggaaaaaaaaatctgttattaaaaaagaatatcatatccaaggaatcacatggttgatgttctcctagttatatgttttcctgcatatgaatacatatacaactgttagaagaaatacaaagtaatgaaaatgtgccacccaaaatcatcttaccagtagaacttgaaccacatactttaaaaaaccacagttccatccctattttttaaaagtagtggtcccttcctcatctccctgcttcccctaaataaaatctcagcagacagacaggctagagcagagctgcttgggctaagatggggagaggcggcctggcgttctgcagccccctctctttccaccttattttccatgaccccctccctttaaccctgacaacaccacagaaccctgctgctatcaggaacacagctgagaaaccactggtctaaaggtcagcatatttggtagagcacaggatgccctgattcccatccaaagacccctggcaactgtagggaatcctctaagctcccctctgccttggttgtctcctgtaactggagcccccctggatctatcttgcaaaggtgtgatgaagacagagactaagacagatccatgtgtccttggaagagtcttggaacacagttattccaggctgaaaggatgcaagtttaaccctttaatacatactgcttgctgatgggagtagcaattggtgtgaccactgcagagagcaatttggcactatggggtcaaattgaagaaggaactgaccctttgacctgccaatgccacttgcaagtacatgtccaagtgtgagttcagaagctcttaaacatgttcatgaggaatatggtcaaaggctgttattgcagtagcatttgtaaatgtgaaaaactggaaacaacctgaatgtctatcaggaggagaatggataatggcattattgtagactcacacagtggtatgctagacagctgttaaaataaactagatgtgtgtcagcatggaaggatcttgaaacataatgttggttgaaaaaaatcaagttccaaaatgatatgtatgacatgattctgtccttatcaatactaaatatactaaataaactgaatatagtttatagatatatatataggtaatagattataaagacattagaaaaatatgtattcatgataataggcagggaaggggttctggggaggaggaacacaaattgggtggctttacacacacatacatacacacccaagcacactcttacacaaatctgataaaattctaacttttctcaactttggtaaatacatatttatttaaacatagttgtttttacttcctacatttaaattaagacattattttcatttggctacaatctatcaaacagttctgtagctcttactaggtatcagattttacaaccttcctaataaccccaggaggtactgttttagaagggaggaaactgaggcacagagaggctaagccactcatccaaggtaaaacagctggtaagagcagagccgggcatcagacccaggtagcctgacacacagtccatcttctcaagcacgtgccacaaggtatccgtggcttgtaatctctcacttgggttccttacatgtaccctgtggcccctcttacactacccattgtctactttgtattaagcgttgtaggagctaagttcacttctccctcttcgtactcctccagctctagcctggctcctgggccatagtaagtcaatagcaactgctgttgaacaacggaatggatgcatgcatgagtggcttcaggttcctggaagctgctctgtgccagtatcatgctcagggtcatcatctctgagtcatctgctgccatctgatgttacccaggatgttggcactaggtatatggaaaatcagcccaactggtagaaaaaaaactcaaataatgtgggatgtttatttcagaagcactacctttctccctctacactggagtagttggtcagggaaaatggtaatttatattttagaaaatatccaggcctccttgcaaatccattttctttctcccactaattcacagtgaacttctggtttcaatttaaatgacaattctgagcaaccttctcttgccactttgccccttccctgctgctattctgcctcgtattaccccttttccatacaggaatttttttttttttttttttttttttttaaacagagtcttgttctgtcgcccaggctggagtgcagtggtgccatctcggctcactgaaacctccacctcccgagttcaagcaattctgcctcagcctcccaagtagctgggatttcaggcgcctaccaccatgcccggctaatttttaaaacacttttagtagagacagggtttcactatgttggccaggctagtctcaaactcctgacctcaagtgatcctcccgcctctgcatcccaaagtgctgggattacaggcatgagatattaaacgtatcacaacttataatcatgtatttatcggtgaattcactctttctaatgtctgtctgttggagagtcaactccaagagtccaatcaagcatcatgcatgtttggctcataatttattgccagtgcctggcacagagtaagtgttcatttatcaccatggaatgaatcttgctgcttaatgcagtggcttgactgaaagacattctacagaggcttccttcttttatttaacagcaagactccttttattaaatgaaatggtccagactcccttatataaaccaacacatggctccggttacactggggaggacgtgtgattggggaggatctgcttggcctgacttctccctgcttttcccaagaagcttccagaggcatctcccagcccaccccttggcaaacttttctgagccctgatcttgagaaaaccagaagggtcttttcacccaggaagcccttctttgtgggttgaaagactgatggtgtgtgctctcctcccaggtccctgattcagccttgtagggcacttgtctaatgaaaccataaattctcccctaaatgagcattctgatttggtttgctcttcatatgaccttttcctggggaaaatgtgaagctttccctgagttatggcaaagactccagtgggtggctgtgtttgtcctgcctctgccatctgatagtctaattcatttccaatttatgagcttgttagttccccagccagttcccaccttggtgctgctgacccggtggcagtatttgcctgtgtcatcttgctcagacaaacacagacgtttccgctgaggaggcagtcccagctctgtcatctctttgactgaccctggctgactccgttgaaagcatcgaaatcatagagcaggctcccttcccatagtcagtgaacctctccgtgtcggcttcagcatggctcagaagccgagtttccctgtgtttactaaatgcttccctgccaaaaagacttggaataacgtctgcctttcaaagtgatggggctgctgcctacactcggtcccttcttcctgctgggattttggacttccctaagttctccatctggaatgctcactggcagattctgtggcaggataggggcaatccccttgctttgaatctgactctgggagtggcaagaagtggaattggaggtgctttctatgtgcctctattgtctggcctctgcaacgggcacaataaagtaccccatagaattctgggagggttaaataaggtgcatacaccaaaggatttaggagtagggtattgtgaggactttacgtacctttatattttatttttatttttttgaaagaggatctgtctcccaggctggaatgcagtggcttgatcatgactcactgcagcctcgaacttttgggctgaagcaatcctgcctcactttttaccaccacgcctggctattttaaaaataaatttttgtagagatggagttttgcccaggctggccttgaactcctggcctcaagcgatcctcctgcctcgacctcccaaagtgccggaattgtaggcatgagccaccgtgcccagactttaagtactttttaagcgattcagtctatgtttatctctatctatgtctacatgtacatctatccctatatttaaatctatattagtttgctttggctaccgaaacaaattaccataaagtcggtggcttaaagcagcagaaatttattcttttcacagtgctggaggccagaagtctgaaagcaggtgtcagtagggctgcattccatctggaggcttgaggggagaatctttccttgctgcttccacttctgatggctattggtgttcctagtcttccttggctagtggccacatcattctaatttctgcctctgtctgcacataccctcttcttctgtgtgtctctcctctgtgtctcttatgaggacacttgtcattggatttagagtctgcccagataatccaggatgatctcctcaccttaagattcttagctcaattaaatctgcaaagatggctaggtgtggtgactcacgcctgtaagccctgcactttggaaggccaaggtgggtggattatgaggtcagaagatcaagaccatcctggccaacatggggaaatcctgcctctacttcaaatacaaaaattagctgggagtggtggcgtgcgcctgtagtcctagctactcagtcctagctacttcaggaggctgaagcaagagaatagcttgaaactgggaggtggaggttgcagtgagccgagatcacaccattgcactccagcttgggcaacagagcaagactccatctcaagaaaaaaaaaaaatctgcaaagatctcttttccaaataaggtgacattcattcacatgttccagggatttgatgtgcacatgtatataaattggccacaaccgtgtctctgctatccatctatacctatatattgatggaaaagcaaaaatattaagatgctaaccatttctgaatctaagttttccatgtgtgtgtgtatatatatacagacatttgttctgcctttgcttatctgtattctcaagttcttctataataaatgtggtgttcttaaataaccagaccactttaaagataatgatgtgaagctgtcagggctttgtgagaagcgtgaagatagttcctgcttttcacagctccccaaccaagagccacacaccctcaaagatgctccagagactctaaaaggctgtagcttgtgtcccaaggaataattgcttttattacagctgtgtaataaggaattgtgcacccacacaactccttatccaaaaatcctgggaatcaaatatgcttttgaattcagatgtttctagattttagaaaaacattcaggcgcatgtactatttattacatcacacacttagtgggggtctgggtggcatcccataatcaaacatattatgtctgctatgatatgtttggatatttatactaagtggagtaaataaaaatctaaataattccacacttaatttggtcagattttgccacccaatgagttttagcaccaaacatatgaaaaacatctggatttcagagatctgtggattttagaattattgagaagaaagcgaaggctgtactagtcttactgctttttttatatgtttgaaaatcttcataataaaacatttaaaaatgaggttgtgcttagtgtcatgtctggcactgaataagatctcaaaaaaatgtgtaaccattaacattaactttgtaatcattaacttattgacagtgttgtaagtcagacagggattactgaagattttgacacagaggaatgacatggtcaggacaagaagaatctagaaggatccctatagctgtggcacccaagatggcttgcatggtgcaagcagtgaagagaggtggttaggaggctctgggactcacccaggcatagggtgataagatcctgagtagaagaggagaagaaagggccaggcatggtggctcatgcctgtaatcccagcactttgggagcctgaggcgggtggatcatgaggtcaagagatcgagaccatcctggccagcatggtgaaaccctgtctctactaaaaatacaaaaattagctgggcatggtggtgtgtgcctgtactcctagctacttgggaggctaaggcaggagaatcacttgaacccgggaggcagaggttgcagtgagctgagatggtgccactgcacccagcctggtgacacagcgagactctgtctcaaaaaaaaaaaaaaaaaaaaaaaaaaagaggagaggaaagagtgaatgaacctggaagaacttggtgagtgttctaggagaacaggatggattcttgtcaccccaatatgcttctgaatgacagcaagagagacatactgaatgtttggtgcatttaggaaggaaaatacatgagtcaattcaggaacaagtcagttggaaatttcatcggcctcctaatctggatagtggcctttgtaagagcagcacttttagttgtaagggttgatttggggcggtgggcttggtaatgaggaccacctgagcatgaagcatagtagcctagtggggcccctctgtagaggcagttttatcccaggttactgatttcaaagctgcagatgctgtgcagatcacaggggctaaggtagggtttctcagccctgattgtgcattgaatcacttggagaaagagcttaaaacactctccactgtagatcaaatagaatagaatctctgggcctaagaccctggcattatgtttgagaagctcttccagatgattctaagatgcagcaagatggagactgctaagtttagggttcagaaggggcaggggaaatgacaaaaaatgcagtcaccctgagctctccctattaatatgcaaaggggaagggtctgggaaatgatttgagtagtgacagagagggaggaagagaagaataacccaaattgggtgaaaacgtaaaaaaccaggagattaaaaaaaaaaaaaaaaaagcaaaaaagcaacactagagatgaactgcgtagtaagcgtgatggactatcccaaagccatcaccatcaccatcgcctaaggggcgatggaagacagagcacaggaaaagatcaaaacaaagcaagatagtccatggaggaattgcaacatttcctcactaaacattgagcgtggggttaagaggttagaaatacagcaaagggaggaaaatgcacagccctaatagagcagttattccttaggatccacactgcagccttttacaaagtccctggagcatttttgagggtgtgtggctcttgggtggggagctgtgaaaagcaagatctatcttcacacttcacatgaagctttggcagcttcacatcactatctttaaagtggtctgggttatttaagaacaccatatttattatagaagaacttgagaaaggcagatgagcaaaagcagaacaagaccaaagctaaattcaacagtcctatgtaaaaccaccaccaaagccagatctatttctttcccattgtcttgtctatttctttcccattatctttcctctgctctgagtgtactttttcttttttcttttcttcttttttttttgaggtgggtttgctttgtcacccaggctggagtgcagtggtgcaatcagggctagccacagccttgacctcctaggctcaagcaatcctcccacctcagcctcccaagtagctgggactacaggagcaagccaccatgcccagcttatttttgtatttttttttttttggtagagatgggggtcttgctatgttgcccaggctggtctcaactcctgggctaaagttatctgcatccctcagcctcccaaagtgtgggattgcaggcgtgagctactgttcctggaatactttttcttcttacacaaaaagattatactagatctaatctgagggaacaggatggattcttttcacccctaatatgcttctgaatgacagcaaaagagagacatactatacaaaatgctgtgtgcatttaggaaggttttgtaattttttttcatttagcaatagattaggaacattttcatttaacgataaattgggaccatttttttctatgttagaaaaaaccacatgatccttttaaatgactgcctaatgttttattgtatgaatatttcggcatgacttaattcccttgtaataaacacatagacaattttcagtttttcagttattttcattgctctaatatcctcatacatgtatctttatgcagttagctgatttttgctttgggaaacattgctccaagtggaacggctgcaacaaaaggtgtgtacatttttaggtctattgattcatagcaccaaactaccctgtgattagccctccccgtggtgtaatgtgagtgtgtgaggaattactcttaaactagtcaatgcagctttatctatatagataaataaggatcatgctgctctagggttctctccacttgatgggatgaagtctaattctctgctataaggtgctgatttacctgggacaaaggtgttcaaacccatcttctctcctatatctccataccccacgtttgtaccctcatgatgtgaacagggtggggtaaaagagattgggaagctctcccagccttctcgggtcctaagtgcctgctagtccttcaaaaaggcaaggaagacaccccctccagttacccagctttagaaacaataaacctctgtggccaggtgcggtggctcaggcctgtaatctcagcactttgggaggctgagacgggtggatgacctgaggtcaggagtttgagagcagcctgaccaacatagtgaaaccctgcctctactaaaaacacaaaaattagccgggcatggtgacatgcacctgtaatcccagctacttgggaggctgaggcaggagaattgcttgaacctgggaggtagaggttgcagtgagccaagatcgtgccattgcactccagcctgggtgacagagcaagactgtcaaaaaaaaacaaataaataaaaaaggaaaagaaagaaaggaaagaaggaaggaaggatggaaggaaggaaaagaaagaaagaaagagaaaccaaacctcctgtgattgaagctcaggagcccccatcattttacaatgactgctttgggcgatttttggtacctaaagatagagtcctgagggtggtggttctcacccctaactgcaaattagaatcacttggaagagattttaatatattctgatgctgaggtcttactccagttcatttaagttagaatccctgctattaggtaggggacttggagttttaaagtgatttccaggtggttgtaattgcccccaaggttgggcaggacagcctcagggcattaaatgacccttgttagagaagatgcaacctggggccttagggaaagccaaaccctttcacacattttcaatgagctctttaacaaccaatttcagactactttaagcattttaaactcttcctgccctcaggcacatagtccaagcagcacattcataaagggagaggctattgcctcagctcaaagaaaaattacacttctttcatgtgaatataccattctgccaatgggcagtttaagtcatcacttccagacaatttgttttataattacaaacctcataaaaataatgtcctacaaattaatcagctgaggaaggactgaaaagcttttgttttgttttgggtggttgttttggctagggacaaactggctcttttaaaaaaggaaaatttccagagtcttgcaaagtccctcagctcactgaatttcatgtcctctggcccttggattttaccatccaactcaggatactcacagtcttcttaataaaccctcactctcctgtcctctaagctgttgctcacatggtggtttttccacttggtgtttccttgaagtaggattgccagatttagcaaaaacaacaacagcacaaaacacagagtgcccagttcaatttgaatttcatataaataacaaataatttttaagagattctgccacttgttaaatgtgtctgttctaagatgcctcctggaaccagggaactaaccacaggatggatttggggacccactgtactcactgtgagatggatctgagctaaaacgccattgcttgactgacctccataagctcttcctctgactagtggaccacagtgatgtttggggttcccaggaattggtgtcaattcagagccagtgtccagtaatcactcaaagttctgattatttcctttttcctaatgcatagtcaccctgataagaaccccttggtccctttggggaaggctgaagaaagattagcaatatacactttgggcagtatagcatggtccttcctcaaggggactcagcctccctttcattcaaaggattctggttctgtaaactgactcaagtttaggaattaatcgaagggcaaggactctgttttggtgattccagttagacttctgttcactcagcctagaactcttctgtatatacagatcacatacgaatttagtagattgcccctctatttcttttttagctgctgcatgatcaaccagccaatgctgtgatctctgtgactcagactcatgattcctgttttgaccccctgtccgtgactgtaaccacacccacgttgcctttggtgattaagtgctgtcatttgtcccctgctccaggatccaattattcccattgcatttagaatcccagcttagtagcagcatttctcattgtaatttctgacattcagataaaaatgaccccagaactcttcaaagatgctgggctcccctgacaaatttatttctcacagttgtagtgaaactaccagggtgaatgagcaggctttacatgacaaattcactctaacattccaattccaatctctctaagcctttgggcaccttcttctaccttcctttacagaataacaatgcagttctggtatttcaacttcatttagtgcaggaccccttttgctccatgtttcagccaaccaaacagccacactgttaaaactcttaactcaaggagctgcaacatgagatccagaatttctgcttagtgggcccatatcagtaaattcagcccaatccaactttatgttccttccactattatcccacacccttgatatccattcccacatatattccctagatttatgtccgtatacattggaaaagtcatgcatttcttttggagtgtagcaccctgccgccaaccataggtcattctttgtacttcaaactttggggcctgctgggacttgagactagttataggtccagaagcaaagaggggtggtgggagtgggttccgaagaagaatcagcactgtctcaaaagataactacctcagaggtggccattacagatgctgcaagcaaaacagtgttaacctcaaactgcagggaggcgatatgcttaggctttgtgtccccacccaaacctcatcttgaattgtaatccccatgtgttgagggagagacctggtgggagatgattggatcatggggtcagtgtcccccatgctgttcttatgacagtgagtgagttctcatgagatctgatggttttataagtgtctgactgttcctccttcacacactcactcactctctcccacctgccaccatgtaagatgtgtctcttccccttccgccatgattgtaagtttcctgaggcttccctagccatgcagaactgtgagtcaattaaacctcttttctttataaattacccagtcttgggcagttctttatagcagttgagaatgaactgatacaggaggaaaggaggatgaagggctgtttctactggcaaaaagacttggcacaatttatgggttcagtgtacccagcttcattgggatctgcccatacgaccccattcaaaatttcaggatctcattctctcctaatccaaaccctcactttaacagcaaataccctgtgaggctgtgaattcaatttccattgtagttctgctattctcaagatgagactctgggtcacttttcagcaatctcagccttgcaggagatacaagagataagggtttgttcctcccccccctgcccccgccggggcagacacagaagctttcaagtaatttatgcagtattttgagctgagaatttgaaactctgagcttattcttttctttccccactttctccagctcagctgagagcagctagcgaatcttattatacttactaatttgactaaaatgttctaaggtatcaaatgcatagtcacccagaaccttgccttttattagtattcggctagtagtatctaatatttgggacatacttgtactaaaaaatcatacattgtttatctgaaattcaaattgaactaggcattctgtatttggtctggcaaccttgctttacagaaatcctctttatcctccaaaattgaagtatatttccaatagactgctccagaaagaagttattactttaattaatattatttattgaccacttacaatgtgtctgttctaagtgctttccataaatgaattcacttaaggcctgattataacttagggctagctattcttttactcccattttacaggagaagctgagcctcagaagagaaaaataagttgcccagtagatcacagcaaaaaggtggtggagtgggatttttacccagacagttaggggtctgggttcacatggataatcatggataacatgacgcgaccttgtgacctcttctaccagaagcttccacagaggtgtgtttgtgccttgtctggggcccttaacatattgttgtctgtctactctagcaggctgtgatatcattggctaatagcagaaatcatgttttatttattgccacatcctcatgtcatgaaacttggaaaaattatatttattattcaactttaaaaagggaggaaattctgacatgtgccacagcatggatgaaccttgaggacattatgctaagtgaaataagccagacataaaatgataaattgtgtgtgattccacttatgtgaggtacctattacagtcaaatccacatagatagaaagtagaatggtggtttctggggcctagggagagggaggtatgggaatgattgattaataagcatacagttatagctgaggatgataaaaatgttctggagatggatggctgtgatggttgtacaactatgcaaaagtatttaatgcccctgaactgtatactaaaaatggttaaaatggtacattttatgtcatgtgtatcttaccacattttaaaataaatgttatacttaacttagcacaggaggttaagagcccaggctcagggttcagtactgtctgagttgaactatggctcagccacttaccagctgtgggatttggggctagtcatttcacatcaatttcatcagtaaaatgtggatggacaataatgcacatatcatgtagttgtgaggacaaagtgaaacaaaatatgctgagtgcttggcacaatggttctcatccccacaaatgggggagatttttaagactatcgaggactagactctcacagataagttaaatctggccttgtgtctttaaacgtttctatttaagaacatttcaaagatacatacaagtgatagatagttctcacataagcataatgtagactgaacatttatcaagattttaacattgaaatatatcacctttttttttttttttttttgagacagggtctcactctgttgttgcccaggctggaatgcaacggcacaacatagctcactgcagtcttaacctcctgagctgaagcaatactctcacctcagcctccttagtagctgggactacaggtgtacaccaccatgcctggctaattttttttttttttggtattttttgtagttatggggttttgctatgtcgcccaggctgatctcaaaatcttgggctcaagctatccacactcttcaacctctcaaagtgctgggattataggcgtaagccaccacacccagtagaatatatcattcttaaaggtgaaagagttattgggacaacacaatgtctggcacatagtacttgtgcaacagatttagctgttattattacttttactctaattagaaatttctttgctttaagtaccttaattttgaaaagggatgctctgaatgggagaggtgcctactgatgtcactgtaaatgtatgactcctattgaaattgtacccagagggttttcttcttctgtgaatcatcctggaagtattctgcatctcaaatggacataaatcaatttgaaccaataacaacgttatttctgaaataccatactgcagtggaatctgacagtaaggtaaaatagagagaaataaatagcatagggaatatggagaggaaatatagtctttcaggcctcaggaaaaagtgcttttaatctgggaatgttctgttatggtactcacccactgcacgcccagggcagacattactaatcaatatactctttcccactgaaccctaaagctgcattagaatttttaagacaatgctttaggtacccaccaacaatcaatgagaggtggcataggagatgagtcgtatatattattctttttttgtacccttttttgtgccttaggtaagtaatactacatacccagaaggaagaaaacgctttctgagagagcaaaacaactgtttgaacttcctcaaaatccaccaaaaacagcaaagtcatttccatggggctatcacagggccatgagccacaggtcattctaagatgtggagtcttagaatccatccaaaaacagctaaaggaaaataacaatagcctggacctggcctggatttctgccatgttggaattggtttgaaataaaagtgttccaacactcttctagttacgaaaattagctttgcctcatgctgccaagtggctaagtctcaaatgtgtatttttccaactttaagttgaagcagtgagaaaactcatagaaaagattaggaaaaaataaggtccatgaaactagtccaatagtggggctgaaaatgacaataatagtaacaatgaaaatttggtgcatattttctatttgccagactttgtgcctaggtgacatgtggttcttctcacttcctctgcacaaacaacctttgagatcagtaccattttcatttgcctttcttagatgacagtcctgaagctcagggaagttaggtaacttgcttgaggccacatgctttgcaagtgatgcagctgtgggatttgagcccaggtatgtctgatttaagacattgtactcttgaacctgtgcattggaggccagcaaggcctttcctttcagcaggaaaagatggcaactaagagtttcagtcatcttcctaacctttctttgacctcactcaaaagggcaagaactcgaatttattcatcattatcttttccattgcattgcataatacctgacatgtaatcagttcacattgagctgaattaatatttggtgaggtttctaaatccagcagtgaactctgcttgcagagcaattgtgggttcttctaaatctttagttgcttgtcttggagccaggttgagtattgttcctgtggctgtgtcccttgtattattagcacatgcattcaacactatttattgagcacctactctatgctaggcagtatggttgcaggatagcagtcaacagaaagacccagtcccagcctttagatttgtagtccagaggggaagacacacttgagcagaagatcatattagcaattgatcatatgcttaattgcatatgtcaattaagagcggatgctacagaggtgctgaagaagggtacctaggggcttacagaaaacactgatggagatggcatcagaatatctaatacatacagtgctagccatgtgtcaagcacagatcttacaatattacatgactcaccttttaaaatcctcataccaattttcaattcctaaagcaaacctctcaccacccatattcatatggggaaactgaagcccagagatgtaaggtaactcactcaaggtcaggacagtaagtggcagagatggactcaaagttgagctgtagctgtaattcaatccctctcctaatctactgtgctgagtcttcccctgggaggtctgaaaaatagttggaattagctttaaaacaggagggggactgttcgagaaagaggaggcggtggttatgaaacccgaattggacagagcttcaggagctgggaggtgttcagaactgtggtggtggcagtggatgagggcagtggtacaggaaggggtgagttgagcaagagttagatctaccaggctgccagggagtgcagctttcatcctaagggcactggtgagttatcagagggctttgcccagggagtgataagatcagatttatcctctaaagtgctcactctggctattgaggagagagagaagagaaggtgctaaggatggaggtagggggagtgtgtggcagggctgggactagggtgagacaagtgaggttcctagggcactgcacttgcacggccctgagagtaaccctctccttcaactttgtgctccagttgccaattgcgtcatccaaatcttagtcctgctatttgggctgctgctgcaagaatctaggccaaggtggtataagccaggcccacaaagcacatcaaggaagctggaaactcatagaaatggaaaatccctttttcacttcttgggtatttatgttcgtttttgactgttagcgcttatcacatgcagttcattttatcttcaacatcagaaagagtggaaagtttcctgggatggaaatctctttgaggttcaatagttctttacaaaaaaaatggcagtagagtcaggggaggtaacagagggagagggagaagagagagcagtggagagggagggggaaaagtatgacataggatgagataagaaactcctttgcaagtgtgaagccaaaggatacataataaaaacaaattccagcagaatggaaagaaaacaaaacgctaccttgaaatgaaatatccattctaaacatgtgcactgcgctttttcagcatcactacagtgtttttgaggtccttttgtgaaagacgttggtcacaaacctatgctttaatctttagccacattttatccaaaggccttgggaacccgtggggtttgctaagactccaccaacgtagacgctcgttcagcagataggatgtttgatgccgcttgctgcaagccctgggaagttcctacgaatcataaagattaaggtgttttttgaagctggtttaaatacacataacacgagagtaacaagccaagtacgagagaatttaaataagctgctctttggagttgctgacactcaggcgtgtgggctcataatttgggattctgaactggagaagattccagaatgaagcttagaagaatgaggtctacttttacctgttctcattctattcttgtcttttggttcttcatttcttaaaatgacctgctggcagcgaccctgtgttagtcccatgggaattactttgtgatttgtggtggattttgaggaaaaggcagttgttttgctctcttggaaattttttgggttctttttgggtacgtagtattgcttaccgaaggcacaaaaaaagggtacaaaatgagagctgggtcctgcagtcaaccacacctgctctgattaaccctcaacccactcgtccctttcatcgttgaatgacattttcaatatcaaccctttgctggttctaaagcacagcagcctgtatttgaatccatttctgttgcatagcttctccgtgaacttgaacaaatttctccacctcttcaagtgtgaaatgggggctaatgatggtactgatttccagggttgctggaagcattaatctaatcacgagaaagtgcatgccaaatgcttggaattagtcctggcacatgctaagcattcattaaatgttagtttttattttcatcaactattggctttcacaaaacttaacaacaacaagcaaaccaaaccctgaggcttcacttttgggaattaaacgattaaatattatgaggtctaagacattaacttttattaatgcataataaatgattacatgtcactaatagattgatatctattaatatacattaaatgattagcttaattacatttaaaaatatctgcaacaactaagaattatatgttgattgatgaaatgggttaaaattaaattaaatgcgttaatatacatgaagcagttacaacaggactcaacatcagatatacactcaactaattatttttttaatttgataatatttgaactctctggagtgactccttcaaaatcacatcatttttggggagacgactgtaagaccaaggaaaaacagtggcattttctcacctaacagtttctcctcaatccatgttccctctatcccctcaatctggtttttctgttttgctcttttctaccttcctgctggtagtcgaagcgagggagaaagagcagaagtaaggtgaggttttacctaacaaatataaatgcttatggtgccttatattttggtgactttaaattttgatataatttcaaatttacagaacagttttaagaataatataaagaactttgattatagcctttatccagattcaaccatggtttatgttgctccattgactctatcagttcctagccctccctccctctctctgtgtatttctgaagtatttgagagtgcctttgtatatgtatttctggatacttgagtgtgtatttcctaagaacaaggtcatccttttacataaccacagttcagctttcaaagtcaggaaatgtaacattgatatattactattatctattccatagtgtattttcaaacttcatcaaatgtcaagttcttttttttaatccagcccaggatccaatctaggatcacaaatgctacttatgtgttttgtctttttaatttccattactctgaaacagttcttcattctttctttgtgtttcttggccttggcatttttgaagagcacaagccagttactttgttaaattattctgaatttggatttttctgctgtttcttcatcctgtatgcaagttatgcatttttggcagaaataccactgaggcattgtctgttgattttataaagcatcttaaagctggtgtcagtaggggtacatttggtggcaagtaaaagactcaactaacactggataaagaacgagaaatctggtggttagtagatccagattggatgtggattctttccattttctactctgctaccctcttcacattgttgtatatggcagtatgtgaactgaacatgacaagaggcttaaagaaggatgaaaggagagattaaagtaatgttctacatttgtcttaacgaggccaacttgttcattagaatgtgaacagaaatgtaataaatacctccatatattacattgccacccatgactgatagctgatggattagaggctgcttccccagaagcagaacctgagacaaggatttatgtacaagtattttatgtgggaagggatcccaggaagcaccagtaagggtgtgaggcagggagggtgaagcaaggaagtatagcagccaggacagggtgtgttgttgagctggttactcctgtggataaccaggtcttggtctcactgggaacctctaggagccacttggagacatgcttcagggtcttgccaccagaaggatgagaaagctggggtactgatgttccaatccctggtatccttggctggaggctgctacagaggcatcagcgccccctgcgtgtataggctaaacagttggaaagcccttggtgggagggtctgcatgctgacagtcagaaactggccaactgcatgatgagagaaagtgatgaggggctctgggtggagcctgggcagtgtctgatcttcctctagctgaaatggacactcctttgtgtgagcactgaactccctcacttctttgttggtgcccatttttccatggggtgagagggtttatcactgtacacattaagccctggtctttctttttctctctctccttgtcccattcaggctctatttcaatctctaagacgtaaggtcatagcctttcacttaaaaaatgttatttgattacatgcacctgtcttttctgtgtttcttccatagggcaagcgtgtgggctttggaacaagccagacttggctccagttctctagttcgtgtgaatgtgagcaggtgactgtcacctttctgagcctcagtttcctcaagtgtaaaatggggatggaatagccgcctttcagggttgcagaaatgaggactaaatacaacatcatatatgagtgcttgacacatacttagaggtagttattacacagagtagcaacatgcatagtagcctgcattgcacctggcataataaatgctaggtaaatggtgagtgtttataattcggggactggcaacgtttttctaaaaagggccagatagaaatattttaagttttgaggcccatatggttcctgttgcagctactcaaatctgcggttttaggatgaaagcagccacaggcgtgtgtatgtttcaataaaactttattgacaaaaaaaagaagtggcccagaagtcgtggtttgctgatccctggtttatgtgattataatgattgttacaaccattgccaggatttgtgtacaagtttactgcccaccaatttggcaaagctcagtccgtttttattttttattttttttttatttttattttttgagatggagtctcgctctgttgcccagaatgcagtggcgcgatcttggcacaccacaagctccgcctcccgggttcacaccattctcccgcctcagcctcccgagtagctgggactacaggcctccaccaccgcgcctggctaattttttgtatttttagtagagacgggttttcaccgggttagccaggatggtctcgatctcctgaccttgtgatccgcccgccttggcctcccaaagtgctgggattacaggcgtgagccaccgcacccggccccatttttattattcatggtagttatgttccataaagccacaacgaacactgaaatagcaaataccaaaatacagctcttagaggaaatacaaggttaggttcctgggagcctctggttgaaacattttttcagccaatcaatacataacctcattttatgtgtgtttctgtttagagacaacttacttaatatatacatgtttttgattcataaacattgaactcagagccaacagcaatataattcacacctgaacaaagcttatctaacatacatattttctctgaaaggcatctcatagcctttttgcattaagggacactaaagagcacttccactctatgcttggggggttggaggagagtgtcactttaaacactgaaggtaccaaaaagagaaagaaagcacaaaaatgcgtcactaactagaccccataaaaagaacacttgtggccaggcgcggtggctcacgcctgtaatcccagcactttgggatgctgaggtgggtagatcacctgaggtcaggagttcgagaccaacctggccaacatggtgaaaccccgtctctatgaaaaatacaaaaattagctgggcgtggtggcggccacctgtaatcccagctactctggaggctgaggcaggagaatcgcttgaacccgggaggcagaggttgcactgagctgaggtcatgccactgcactccagcctgggtgacaagagtgaaactctgtctaaaaaaaaaaaaaaaaaaaaggatgattgttcactgtgtgcgagctaaaacaagtagtcagggtgttgccttgtttgacaggcttagaagtgcatcttaaatgactcaactttttgtgctctgcacatatgcatgtctgtgaataactgtgaaaatgccagaaacgttgattttggggttacagataaattttagtatgtaggccagttcaccaatacaaagaaaaatgaggattgggctgggtgcatggcttacacctgtaatcccagcactttgggaggcagaggctggcggatcacctgaggtcaggagttcgagaccagcctggccaatatggtgaaaccctgtctctactaaaaatacaaaaattagtggggcaatggtggcaggcatctgtaatcccagctactcaggaggctgaggcaggagaattgtttgaaccaggggggtggaggttgtagtgagccaagatcgtgccactgcactccagactgggtgacagagtgagagtctatctcaaaaaaaaaaaaaaaaaaaaaaaaaaaatatatatatatatatatatatatggcttaccctatggactttgcatgatatgttttttatttttattttatcttaggctttccagtttttaactctttaattatttaaataatttcatgaatatatgttcaacataaaaacattaaaatgacacacagctataaagaataaaaagtaagttattcttcacattccttttgtactagattccagtttttttctccagaggtcaaacagctcatagtgtgatctttttgagatttaaacacacatgtgtatgtacacaaaacacactactttaaaaagtaaatgggccacacaaaaacctgcacataaatgtctaaagcagctttatcggtaattgccaaaacttggaagcagccaagatgccttttagtttggtaaactgtgaagcctccagacagtggagtattattcagctttaaaaagaaatgagccattgagccatgagaagatacggaggaaccttaaatgcttattactaagagaaagaagccaatctgaaaaggctgcatatgggatgattctaactatatgacatattggaaaaggcgaaactatggtaacagtgaaaacccagaaatagcccaaatgtctatcaagtgtaaaaattgataaattgtggaatactaaaaaagaatttgctgttattactagtatcctagaagtaggattgctgaatcaaaagttatgtgcattttagatcttaatatcacaaacccctcatcccaccctccaaaaccctccagaagagaggctctttcaatttccattcccaccaacagccattgagactccctgtttgcctgtacccttgccaatactgggtactatccattaatttaccttttgccaatctgatgggctcatcctcctttacaactgaaattcttacaactgggacctgtcataaaattggtgtgtaggagcctttgagaaggctgtcggcaaatgaagcaaaaactccaaccctctaattttccacacactgatttaggctctttggaagattaacaaatggttatcagggtaattctgaaaagaagtgggggcagagattcccacacagaacctaatgttttctgggttggtgggggtgggggggctttgatttgaatggctccaggaccccctctgccagatgtcagcaaatcacagacattcatctagctgaaagccaacctattcagtctttctgggcaacacattcagacagaacccagcattcttggctcagggtgatgaaataaataggacttaatttatattttaaagtctttttatctctctgtaagcccctgtgcttcattgaaagaaaatttgatcgagatgtagagaggtcagaatgcagctttaataattcacgatctgtaatcttggccctttcttactttgccttaacatttatttggaggtttgccatttccctctgcttcccctacatgattcttgagcgacagtcttgtccttcttctaaactctcttgcctcagcattcagaccgtttcgggtaggatcggaaggtttgatatccactttgaccaatgagagactttgggggcaaactggggcccctgaccctctctccaggagccttgatctgccagttagaatatcttatattgataagattagttggtaattaacagcccagcccagtcaagcagaggagatgactcaattagcagaatgtcactccatctaatttactttgcttatcagagatttattttctaatgactacaggaagaagaacagggcaccttcagaggagggatcagaaagggtttaaaagcttcagtgtgctctaacctctctttttcagctggtttgcctggcagtgaggaggctgataatgccaatttggggaattggctggtctgatacacctatctcaaacttgggaaaaaagaggttgaatgtttctgttatccctctatctgattcttttctttatttttaagttttgtgggtacatagtaggtgtatacatttatggggtacatgggatgttttgatacagacatgcaatgtgaaataatcaaatcatggagaatggggtatccatcctctcaagcatttatcctttgtgttacaaacaacccaattatactcttttagttattttcaaatgtaaaattaagttattgtctattgtcacccctttgtgctcacatagtaggtcttatacattctttctaactatcctctatctgctttatattttttgagctaatcctgtttgtcatctttgtttgatgagaaaactcctcccacagctacttagctttagctagagtagtagtagcaataacaccacctacaataatactagacaaggtatttattaaagcctcttgataccccaggcattgtgttaaagactttacattggacacataacattgaatcctctacaccacagttggcaaacattttcttaaagggctagataatattgtagttctggggaccggtctttgttgaaactgcccaagtttgattgtattaagaaagcagtcatagactataggcaaataactaagtatgacttgttccaataaaactttatttacaataacagtcatttggccagatttcggctgttggccatagtttgctaacgcctactttaaatcagtgtttctcagacttcatattgtgatttatttagtcacagaatcaatgtagatggttgcaaaactcattttttaaaaacatgaaatagaataaaaactatgtggctgggcatggtggctcacacctgcaatcccagcactttgggaggctaaggcaggtggatcacttgaggtcaggagtttgagaccagcctggccaatatggtgaaaccctgtctctactaaaattactaaaaaattagccagccatggtggcatatgcttgtaatcccagctactcaggaggctgaggcaggggaatcccttgaacctaggaggcgagcctgcagtgagccgagattgccccactgcactccagcctgggtgacaaagtgaggctctgtctcaaaagaaaagaaaaagaataaaaactatgtgaatgcatcacctctaatatggataactcctatttggtgaaattttaatttcagatgtgcgtgtatgtaaaaccatatatgcatatggatataggtgtgtatgtatttgtgtgcgtgtgagtactgggtttcaatgtgaagtgtgtatcttattgcagattataagagtttgaaaagtcctgctcttaactacctaaagtaagtctcattattacatgcattttacggttgaggaaatagagatgtggaaagacattcggtgacttgccccaagttacacagcctgaggagccagattttttgataagacagcaagcctctgacatacagcattttcccatgcccactttggaatgggttaatagcagtgaaatggttaaaattccttccagtggaaggaaaataaaacaagggacaggcatagtccacaaattgaatggcttcttgctgaagcgaacagaaacgtctctttttccttcttggtattttcattgcaaatactatttatcacaatgtatttttcccccaacgcattttagaaagtcagttggaattgatttgaggctctaaacagtctcctgaatgaaaaagcaaagtgtaacctattctaacagcccctcttccttaatctagaaacatggggagatgcaatttaaatgataatgttaaccaaaacgggagaatgcaatgctatagtaggagtgtttgttttgttgtttttttaacccccactgaaagacaaatggctgagacatttatatctgcagcacttattaaggagaaaatgctcaacccgttaatttcattgctgtggtgctgaatatgaagaaagaatgtagtttctgagtgactgctgaggactcccacagtcctacaagatggcggccagggagggggattctgtggcaacgttcgagaagtcctgaaatgtcgtccgttatctaacatttatctgggtgttgcagaataagtgtttctcgaagtgagacttcttggaacattttctcttaaactgaggctttggagtcactttgtaagtttgtgttttaaagccaaccctctaaaacttgtttgctgatcaatttaaagacaggtctccctggcaaccatgttgtacacagggtatggattatgtatacagaagatagaacgtagagttatctgaaataatatgttagtttcagtaagaaaagaattagtcagaaataaaataaagtaagcatattaggattttttttaaaagtgtgccccaatttaaaaacacatctataggaaataaggaagaatatacactttgatgattctgctacctaacaagacgaccattactattttataatgggttttgtttttccatcttttttctttcttttttttttttttaaagtgctttggttaagaagcctcacaactctccccagttaacaccttcataaggaaagcaaaattacaagacggcaaatgtaccaattaggactcagtttacctgtgttttcatgctccagagtgtttgatacacatttaacaacaagcgatgtttagaggagggagcccaaactacctctacccataagactcctctaaagtatctagggtatttataccatgccctaacatcttagctgtgccttgcaggtttttgcataccaaggctttgtgggcaaaagatccagaactaaacgacatctacctagtctatgttacaggctgtgccttcaaatgtcaagctttgctaaccatgtctcattatccaacaagcttagtttttctgatggctaccatgtccagtgtcgctcagagaacttccaaaatttcctatactatgtacgcccattgattgaatatatatacacatgcatacacacacatacatacatgcatatacatatacacacatattattttgcatatgtttatatatcttcacatacataaacatacatatgaccaaaatttatacatgcatctactttaaagagccaaggttctaaaaagcttgttataaagagcaataacttgcttctcctcatttccttccatttctctcccttcggaggcaaccactgttgtctcttgtagctgattcttttggtaccttcggatacttaaatggcatgtttataatgtgatgtcttgatttctcatattcaggtattaactgttgttttttttcctcaaggaaaatgagaatttcgctttcttgcccctccctccctgcctccacgacctctacccacaacgcacacacttcctgtctgagtcttttgcaatgatttttgatagtttaatattcgttatttccctgtgtcatgaccatgccaaatgccttccacagttgcatcatgttctgtgatatttttttcctttactgcacaactttttgttttccatgaagttaataatagttgccttttaaaaatttgcttaacgttttgtatgatctcaaccctggttcagtctccaatttttggctagttctgtaactctcctctgattgtatccctctgtatcacaaagctattaattctactttccaggagtatgaagatcctggggcttcaagcctgctctctgctccctacaccaggggagcaaactcattctgggcaatcccctctgtccatcctctgtagtggagatcctatttctcaaagaaccatatgttctatgttcttggtttatcccctcaatttcgttgagtacttctcttactagccttctgaaaaaggacttattattattattggagatgttgcatataggtgttggctatagaatcctaggttggaaatataaacctcaaatatttgagacaggtcccagtcaatttagaaagtttattttgctaaaataaactttagcaaaaaaaggttaaggacgtgtgcccatgacaactcagcctcagtaggtcctgatgataggtgcccaaggtgcccagggcacagcctggtttttgtacattttagggagacgtgagacatcaatcaatatatgtaagatgaacgtgggccaggcgcggtggcgcacgcctgtaatcccggcacttcaggaggccgaggcgggtggatcacctgaggtcaggagttcaagaccagcttgactaacatggtgaaaccccatctctactaaatacaagaaaaaaaattagtcgagcggggtggtgcatgcctgtaatcccagctactggggaggctgaggtaggagaatcacttgaatccgggaggcggaggttgcagtgagccgagatcgtgccattgcactccagcctgggcaacaagagcgaaacaccatctcaaaaaaaaaaaaaatgttgaaagctggttgggtccagaaaggcaagatgactcaaagtggggaggggacttccaggtcataggtagataacagacaaaaggttgcattcttttgagtttctgattagcctttccaaaggagacaatcagataagcatttatctcagtgagtagaggggtgactttgaatagaatgggaagcaggtttgccctaagcaggtccaagcttgacttctccctttagcttagtgattttggagtctcaagatttattttcttttcacagaaatcgctttcctcaaaattttgaagacgtgactcccctgtcttctagcttttagaattgctgctgagaagtctaaagccactctgattctgactctttgcatataatctgctttttctcttggtaaatgtgtaaaatttctttgatcctggattttgaaaatgccacagcaatgtgcctcagtgtaccttggtcatggtgctggtcttttgaacctgggaacacacgctcttcaattctggagaattttcttgagttatctaatggataattttctcctctccatttttttttcttgttttctctttctaaaactcttgttattcagatgtcagttcactattttttaaaaaaaattcttctctcttattttgcatccctttgtctttttgctctcttttggaaaaatttgtcagtctcatcttccaacctttttacttttactcatcttccaacctttttactaacgcattcatttgtgcgttagcttctgagggcttcttttgcatccctttgtctttttgctctcttctggaaaaatttgtcagtctcatcttccatcctttttactaacgcatgtgcgttaacttctgagggcttcttttggcttttcacgtgttcctgtttacagtcccaagtagagtatttggcacaatgccctaaggcatggtagagtaacagcaaggaggatgatgtgcttggaacaatgtgagcaagagtgactgtgggagccaacaaagctatgaaagataattggaggaggcacatcacatagcacattatggaactctgactccaagtggtgaagctggagtctaagcctagctttgtccctgctttggaaaactcagtctttctgatcctcagttttcctacttgtaaaattaactgtttgaatttctaagaaaccttacaactcaaatatgctcatgaatctttgattacatcaatgttctctccctaaagcaggcaaatcacaacacttaaatttgtgtatatatatttatgcttttctagatgcccaagtatatatgacttctaccatccagtaaaacagaccttttaccctttaggaaattacaggttgagagttaaattctataattagtaagtattgttttattggaacaaagattaggtttccccaaagtcgtagaaattaatggcaaggtcagattagcatgagggtctttggtcttctagcgttcccaactccattgcagaagctctgagcaagtcaactctctcagccatgaccaagaagaagctaattcatctgaaggaaaatgctgagcctgccttcagagtccttcagagtaaacctgctgcacaattagctgaaggaaagggccttgcagggagtcagcacatcagaaatgcaccattactcagccaggggctgacattcagccaatggcagccccttgtgtagatactggagtggatcccacggagaatgagcccgctcacccagcatggggtttacagccgccatgaacctggaggagaggacatttgggccagagcattttggcttcctctgctgtttgagatgggtttgtcaccaggagcaagcctttgctgagttctccctcctttaaagaattgttttctctaaattaattaaattgatgagaataaagagggccaaattgatggcacccaaatgcatttgaaagtgatcagaaaccgccaggaacaccataaattccataattagaaagtattttcttaaagggacaaagatcggatttccccatttcagagttggaaatgccccttgattaatttcctccagcctgtctcttaatgatatgaaatgcaatcaagataagtaatcaagaaaatcaaagtgtcctaagtactttaggtaataatgacaataacattcaaccactgcaataaccagagttatatattatttgtgcgtttttaaacctcatactagacactgtactaaacatgtcaaaagccttgtcccatttaatacctagaaaacaccatgaggtagaaactattcttcttgccattttacagatgacttcaggtgacctgcttggaaagctttgtcagttgtccacagtgatgcagcaagtgaggggtggagctggaatttgaacccaggctgtcaaaatgcaaagtccagtcctctgaactattatgctataatgcctcttaaagttttttttcctattgtcaactctgaatgtcatgttgagtataggagaggaagtgtatcttttctttctcagtcatcagggaaagaacattcattttgctgttgtttttaacttctttttttttttttttttttttttttctgagacaaggtcttgctctgtatcccaggctggagggcagtggtacgaacttggctcactgcaacctctgccccccgggttcaagcgattctcctgcctcagccacctgagtagctgggattacagacatgtgccaccatgcccagctaatttttgtatttttagtagagacaaggtttcaccatgttggccagtctggtctcaaactcctggcctcaagtgatctgcctgccttggcctctgaaagtgctgggattacaagtatgagccacaacacctggcctattttgcaattttttcaatgtggcaaaatatatacaacacataattgaccattttaaccatttttaagtgtacaagtcagcattaagtacattacaatgttgtgcaattatcacactatttccagaactttccatcttcctaaacagaaattctgtgcctattaaacagtatctttccattcctctcttcccctaatccctggtaacttctattttctgtctctgtgaatttgcctattctgggtatcttatacaagtggagtcatacagtatttgttcttttgtgtctgacctcttgctcttagcataacgtctccaaggttcttcctcctcctttttttttttttttttttttatgagatggaatctggctttgtctcccaggctggagtgcaatggcacgatctcagctcactgcaacctccgcctcccaggttcaagcaattctcctgcctcagcctcccaagtagctgggattacaggcatgtgccaccacgcctggctaattttgtattttttttttttttttttgagacagagtttcactcttgttgcccaggctggagtgcaatggctccatctcggctcactgcaacctccggctcctgggttcaagcgattctcctgcctcagcctcctgagtagctgggattacaggtgcacagcaccatgcccggctaattttgtatttttagtagagatggggttttgccatgttggccaggctggcctcgaactcctgacctcaggtgatctgcccacctcggcctgccgaagtgctgggattacagacatgagccactgtgcccagccttttattattattattattattattattattattattattattatactttaagttctgggatccatgtgcagaacatacagttttgttacataggtatacacatgccatggtggtttgctgcacccatcaacctgtcatctacattaggtatttctcataatgctatccctcccctagccccctacctcccgacaggccccgatgtgtgatattcccctccctgtgtccatgtgttcttattgttcaactccctcttatgagtgagaacatgcggtgttaggttttctgttcctgtgttagtttgctgagaatgatggtttacagcttcatccatgtccctgcgaaggacatgaactcatcgttttttatggctgcatagtattccatggtgaatatgtgtcacattttctttatctggtctatcaatgacggacatttgggttggttccaagtctttgctattgtgaacagtgctgtaataaacatgtgtgtgcatgtgtctgtatagtagaatgatttataatcctttgggtatatacccagtaatgggattgctgggtcaaatggtatttctagttctagatccttgaggaatcaccacactgccttccacaatggttgaactactttacagtcagtgtaaaagcattcctatttctccgcatcctccccagcatctgttgtttcctgactttttaatgatggccattctaactggcatgagatggtatcgcattgtggctttgatttgcatttctctgatgaccagtgacgatgagcattttttcatgtgtctgttggctacatagatatcttcttttgagaagtgtctgtttatatccttcactcactttttggtggggttgtttgtttcttgtgaattttagttcttgtagattctggatattagaccttcgtcagatgggtagattgcaaaaattttctcccattctgtaggttgcctgttcactctgatgatagtgtcttttgctgtgcagaagttctttagtttaattagatcccatttgtcaattttggcttttgttgccattgcttttggtgtttttatcatgaagtctttgctcatgactatgtcctgagtgatattgcctaggttttcttctagggtttttgtggttttaggtcttatgtttaagtctttaatccatcttgagttaatttttgtgtaaggtgtaaggaaggggtccagtctcagttttctgcatatggctagccagttttcacaacaccatttattaaatagggaatcctttcctcattgcttgtttttgtcaggtttgtcaaagatccaatggttgtagatgtgtggtattatttctgaggcctctgctctgttccattggtctatatatctgttttggtaccagtaccatgctgttttggttactgtagccttgtagtatagtttgaagtcaggtagcgtgatacctccaggtttgttctttttgcttaggattgtcttgcctatgcagcctctttttttggttccatatgaaatttagtttttttaaaattctgtgaagaaagtccatggtagcttcatggggatagcattgaatctataaattgctttgggcagtatggccattttcacgatattgattcttcctatcaattagcatggattgtttctcaatttgtttgtgtcctctcttatttccttgggcagtggtttgtagttctccttgaagaggttcttcacatcccttgtaagatggattcctaggcattttattctctttgtagcaattgtgaatgggagttcactcatgatttggctctcttattggtgtacaggaatgcttgtaatttttgcacattggttttgtatcctgagactttgctgaagttgcttatcagcttaaggagattttgggctgagacaatggggttttctaaatatggaatcatgtcatctgcaaacagagacaatttaacttcctctcttcctatttgaatacactttatttctttctcttgcctgattgccctggccagaacttccaatactatgttgaataggagtgatgagagagggcatccttgccttgtgctggttttcaaagggaatgcttccagttttttcccattcagtacgatattggctgtgggcttgtcataaatagctcttattgttttgatatacgttccatcaatacatagtttattgatggtttttagcatgaaggggtgttgaattttatcgaaggccttttctgcatctattgaaatacgtatgtggatttcgtcattggttctgtttatgtgatggattacgtttattgaatgcatatgttgaatcagccttgcatcccagtgatgaagccaacttgatcgtggtggataagctttctgatgtgctgctggatttagtttgccagtcttttattgaggatttttgcatcaatgttcttcaaggatattggcctgaaattttctttttttgttgtgtctctgccaggttttggtatcaggatgatgctggcctcataaaatgagttagggaggattccctctttttctattgattggaataatttcagaaggaatggtaccagctcctctttgtacctctggtagaattcggctgtgaatccgtcaggtcctggactttttttggctggtagagtattaattactgcctcgatttcagaacttgttattggtctattcagggatttgacttctgcctggtttagacttgggagggtgtatgtatctaggaatttatccacttcttctggattttctagttcatttgtgtagaggtgtttatattattctctgatggtagtttgtatttctgtgggatcagtggtgatatcctctttatccttttttattgtgtctatttgattcttctctattttcttctttattagtctggctagcggtctatctattttgttgatcttttataaaaaaaacaactcctgggttcattgattttttgaagggttttttgtgtctctatctctttcagttcttctctgatcttagttatttcttgtcttctgctagcttttgaatttgtttgctcttgcttctatagttcttttaattgtgatgttagggtgttgattttagatctttcctgctttctcttatgggcatttagtgctatgaatttcactctaaacactgctttagctgtgtcccagagattctggtacattatatctttgttctcattggtttcaaagaacttatttatttctgccttaattttattatttacccatcagtcattcaggggcaggttgttcagtttccatgtggttgtgaagttttgaatgagtttcttaatcctgagttgtaatttgattgcactgtggtctgagagagagtttgttatgatttctgtttgtttgcatttgctgaggagtgctttacttccaattatgtggtcagttttggaataagtgtgatgtggtgctgagaagaatgtatgttctgctgatttgggtggggagttctatagatgtctatttggtctgcttggtgcagagctgagttcaagacctgagtatctttgttaattttctgtctcattgatctgtctaatattgacagtgcggtgttaaagtctcccactattactgtgtgggagtctaagtctcaatgtaggtctctaagaacttgctttatgaatctgggtgctcctgtattgggtgcttatatatgtaggatagttagctcttcttgttgcattggtccctttaccattatgtaatggccttctttgtctcttttgatctttcctggtttgaagtctgttttatcagagacaaggattgcaacccctgcttttttgttttttgttttttgctttccatttgcttggtaaacatccctctatccttttattttgagcctttattttgagcctatgtgtgcctttgcatgtgagatgaatctcctgaatatagcacgctgatcagtcttgattcttcatccaatttgccagtctatgtcttttaattgggacatttagcctgtttacatttaaggttaatatcgttatgtgtgaatttgatcctgtcattatgatgctagctggttattttgcccattaattcattcagtttcttcgtagtgtcaatggtctttaccatttggtatgtttttgcagtggctcgtactggttgttcctttccatgtttagtccttccttctggagctcttgtaagacaggcctggtagtgacaaaatctctcagcatttgctcgtctgtaaaggattttatttcttttttttttttttttccttttttgagatggaatctggctttgtcacccaggctggggtgcagtgtcacgatctcggctcactgcaactctccgcctcccaagttcaagcaatgctcctgcctcagccttccaagtagctaggattacaggtgtgcaccactacgcctggctaatttttgtattttagtagaggtggggttttgccatgttggccaggctggcctcaaactcctcacctcaggtgatctgcccgtgtccgcctcccgaagtgctggggttgcaggcatgagccaccacgcccgcccggccttcttttttttttttttttttttacatagcaagctgctaagtgcatctctgtttagaaattgccttaacattgggtttctattgacagaacaggggaggagtttgcctctgacttttctgaagctcccatggtacctgaggctaagcagcccacagttaattttaattggcaaaagaaatgagaacaaattcctccaggatgagaagtacatttctgctaaaacagtgctctcccacagggtatatgaacacattcagtcccctctagaaaagaaccagagggcaggcacggggtgccagctgctagaaatcttgcagttagattagaatagaagagtgtctgagtttttagataattttaggtgccaggatatggttaggaggctatgttcagggctactcttgctactgttgaaataaaaaacaaaaataactgcctagagaacatccacgccctaaaagacaaaccatgttttctgggtgaagggatgatttaactcaggaaactcaagaacacaaaacaacaacaacagaaataatctccttgaacatattcaactagaatggcaaggcattttccaacataaaacactgtaattttcctgctactccaaaggaatccaataaataattttacaaaattataatcaaaactggaagtcatggccaggtgcgttggctcatgcctgtaatcccagcactctgggaggctgaggtgggtggatcacaaggtcaggagttcaagaccagcctggccaacacagtgaaaccctgtctctactaaaattacaaaaattagcaggtgcctgtaatcccagctactcaggaggctgaggcaggagaatgggttgaacccgggaggcagaggttgcagtgagcccagatcgcgccactgcactccagcctgggcaacagagctagactccgtctccaaaagaaaaaaaaaaaaaaacctgaaagtgacaccagccccctgacaacacaagtcacaggtccttgtgcagtcccagggttgagtggtccaagaaagccactccctgagcccagcctgaggtttcatctttcccgaatgggatcaggtagagggtccatgctgctttgcagaagatttgcatctggtaagcccaggtggtgaatgaaggcaaagaagacaacacgagaagatgtcaaagccaaggtttcctcgcgctgaagccaggccttaggaggcaagttctttggtggggcctctttgcccaagctggagcaagtaccctgtacctgtcatgcagggaagagtttgggtgggctttctacttagcaggactttgctatggagtcctggtaggtgttctcatgttgcatgctctgagatgaggtcctgcatgtggccaggcacaactcaaagtgttcttcgactgccatgaagaggttctggaaagccacagctgcccgacggaggaagcactccaagaaaagctgcttgttgggcagcagccgcgggaccagcagccatcacagcagtattgctttgtgccagagacattgatgttacagcagccgctgggccagcagccatcgcagcagtactgctttgttccagggacgttgatgttgcagcagcccctgggcgagcagccatcacagcagtattgctttgtgctggggccgttggtgttacagcagctgctgggccagcagccatcacagcagtattactttgttccagggatgttgatgttgcagcagctgctgggccagcagcggttgggccagcagctgtagcagcagtattgctttgtgctagggacattgatgttgcagcagcagttgggccagcagccatggcagcagtattgctttgttccagggatgttgatgttgcagcagccattgggccagcagccatggcagcagtattgctttgtgctagggtcgttgacgttgcagcagccatccaccagcaaatccttcctctcacaaacatagttcatctatgatgtggtgctcccctcaaatggagtggtggcactgattgctggggtgactgccattgcccgagttaaactgcactttacacggaatgggctgatcatggtcttgaacctagaggagattcctctctttcactgtcctctcctcctgcttgaaggtgctcctgaggaagtagatgagtgacagcccaaagaccagggcgagcacccacctcctccgcagacatcggtgctaaaccgtggcctcctggttcaccatcccgtgttgtggaacatggcaggcccgaggctcctacacaccccgcagccccatcccttgaagcaggcactgaccccgtggcccatggccgagtcccaggtttatttttcttaccccatatatcagaatttaattcctttttatgatgaatgatattccaaggcatgttcctttctttggtagccgtcctaattggtgtgaagtggtgtcccattgtggtttgttttgttttgttttttgtttttttgaattattattatttttttgagaggagtgtcactctgtcaccaggctagagtgcagtggcgcgaccttgtctcactgcaacctctgcctcccaggttcaagtgattctcctgcctcagcctcctgagtagctgggatcataggtgcctgccaccacacctggctaattttttatttttagtagagacagggtttcaccatgttgaccaggatggtcctgatctcttgaccttgtgatccacccacctcagcctcccaaaatgctgggattacaggtgtgaaccaccctgcctggtccacattgtggttttgagttgtgtttccttaatgatgaatgatgttgagctgattggccatttgtgtatcttctctggagaaatgtctattcaagtcctttgttcatttttgaactgtgctgtttgttttttgttgctattaagttataggagttctttacatattctgaatattaattcttatcaggtatatgatttgcaaatatttcctctcatttggtgggttgtcttttcactcttttgataatgtccttcgatccaaaaaaattataatttgatgaagtccaattcatgtattttttctttgttgcctgtgcttttgctatcatatttcagacattattgccaaatacaatgccatagaaattttcctatatgttttcttctaagaggtttgtagtcttagctcttatatttaggtctttgatccattttgagctacattttgtaaatagtataaaggagccaactttatgtttttgtatgtgaatatctagttttaccagcaccatttactgaaaagatgacccttttcccctattaaaaatcattaggccatatatgtaagagtttatttctagggtccttattgtattcctttggtgtagatgtctgtccttataccagtactacactgttttgattactgtagctttgcagtaagttttgcaatcagaaagaaacttttcttccaagaaaagttggtttaattcacatgagatgaaaattaaaatgtgggtaagtcttagattggttaacgcagaggaagtagcactcaagctattttgaagaccaaagttcatcatctaagccacagtcctcctcagagctcatgcccaccaatctttaatattacaaatggaggaagggtagggatggagatcaaggatagtgctggcaagggtatgaattggtccgacctttttggagggcatttgggaataagaatcacaacacttggatatgggttactgtttgacccaggaattatgttttcaggtagagtaataacaaatggacttgcacagaaattttcctgcaaagatgttcaacccacattgttagcatagcaatgaacaacaaaaaaagtttgagtggcactggctaaattatggtgcaaccatacaatgggatacccgttggctgttagaaacacgtgttgaagcctatttgtagacatgaaaagatgataagtatttaaatttgaaaaaaaaaacaccattatatgtactatgcaatttcacaattgtcagatttggagatcataaaatatccaaacacacacacacacacacacacacacacacacccacacacactctggaagggtagatgctattactaatcgtcgttatattaggtctggctttccaaaagcaggtcctaagagaaggattcacgtgcaacagatttattttttattaattaattaattaatttactttttgagatggagtcttgctctgttgccaggctggagtgcagtggtgcgatctcaactcactgcaacctctgcctcctgggttcaagtgattctcctgccttagccttctgagtacctgggattacaggcgcgcaccaccatacctggctaattttttgtatttttagtagagatagtagagacggggttcaccacattggccaggatggtctcaatctcctgaccttgtgatccacctgcttcggcctcccaaagtgctgagattacaggcgtgaaccaccacgccggccacaacagatttattaagggagtgcttccaggagaaactggtaagggagtgggagaaacagggcagaaaaggataggaagcaaagccagcatgcaattttaggccaagtccgatacagcaggggtccccaactggtctatgggaccaatacctgtccatggactattaggagctgggctgcacagcaggagatgagtggtgggtgaacgagtaaagctccatctgtatttacagccacttcccattgcttacattgctgcttaaactccacctcccgttggatcagtggcagcattagattctcataggatcacaaatcctactgtgaactgcacatgtgagggatctaggctgtgagctccttatgagaatctaatgcctgatgatctgtcactgcctcccatcacctccagatgtgattttctagtgaaggacaaacaagctcagggctcccactgattctacattatggcgagttgtacaattatttcattatatattacaatgtagtaataatagaaataaagtgcacaataaatgtaatgcacgtgaatcatcccaaaaccatgcccccaccatgcatggaaaaattgtcttccacaaacgtggtccctgatgccaaaaaggtggggacccctgccatagaggataacttcagcctgatctcacagagaaattctaagtgtaaattacaccttaggtttattctaacccaaggcaaggaagctgggctttcaaactccttcactcagcagtcattggttaaaggccaccctggacggggatgtaaaaatcccagacatgatgaatgcagctgctccagtagcctgaaggcaggccttcgaggcaaagccacaggtgcaggccattgggagcaaaagcttaccaatgttgaggaagagatgtgaagaaatggtaaagggattttaggggatgtgagtggagcatgccatttagcattctttaaatttttgtagatgaggaaaatgcattatttttgtaataacaacatgtcatttaaaaattactgttgaacaaatacctttcaaattcctctacaatctcacatctatttcacagaattatgtttggtattctgtgggggaaaaaaggctttttcttcttggctgagtctgtatattaaaaataaagaaaaaaaggctttttctcatagccctgcttcagtgactgtcttggcaatattctaataaagctatgaggcttcaaaatccttaccccagagaccaacctatatcattaagggtaataaatacagtcaaaacaatcatgacaacaatgacatgtggaactatcctgtacattaatattgataataatagtgacatgtattggagtgctgtatgggctgggtcctgggtgaagcactttacatgcattctctcattaaattatctgaataatcctattagttaattacagtgattatgcccatttcccagatgtgaaaactaagggccaaaaaacgttaagtaatttgctccagcaaaaccaataaaaggcagagtctggactcagctcaggtttgccttgtgccaaagctcatgtttgaaatctctgcactgtgatatatcccaatccatgtgcttctcttatattttaaggaacattaagtcttgaattctgatcatgggccagttcttctgttatattgtactcctttttacatgtaatcctgagaatatttttctgctggttttcccagccttattggacaattcatttgaacttctttctatttataatctcataggaaaagggctgatgtatttgtaaaattataagcaaaaacccgtcattgtccatggagaatacctgccccagtgcaggctgtgttgaacattttataatattcaaacttcaatcactgcattccccaaatgatagctttctctgatctaaggggaaaccttacctttttgtctgctgcaaatatacatgttaaaatggacagaggccaacaggtatattataatgtgagaaaagcactttctaggacagtagaataagggtgataattttagaaattgccaaataggatagatgggtggcttctttcttttccttaactgctttcttttcatcttcagcttcagtctaaattcctggtatagaactctacatgacacaggttgaaagaaatagaaacaagcatatagtttaaaagaaataggatttcttcccaggttaaatttctagctaaggattaatttgcttgcaccagactcataactttccagatttctgtttgcttatgtatgagggggaaaaaaagctcagctaggctgaatatagcgattagttaaattgctcagacattcattattgaaaaacctcaattccacttgaagttggggtttgtttagcactcactgacaataactttctgcttgactgatggctactaattttgatagtggtatgggaatgtcagtcacaaatagaaatagacacacagactctaggacccattaagctggttaccatgctcacatccccaaatgtgtgttgtttcaaaatataggctaaagagatttaattacattctgggataggaaacatttacgtttcaagtttgcactggttgggggatgctaacagagaaaagaagagtaatgaagcagagagatctcggggaatcaggagagcatcacacctgctgacaggtgcaaagaacagacctaacatctgtgaaggaaaagtcgagtacttcaggaacaaggtggtgggaaattaaagcaccaagagatgttaagctgctccaggaaacaggctgggagactgattgtttgtctcaatcaagagatggctgcacctaaaaataaggatagagcccatcagactttcttttctccctcttctttcagcccattggccttgatttggtcttaaggcatgaaaggaagcctcacggagcccagctacattttcatgccgtgaaaatgagcacttaaaatgtaaacagttctcccaactgcatgtgctgaaggcaaatggattcggaagaacttcacccactgttctcagggaatggttgctctgtggggtgtctctgagacccacaaggctaaggttctcattgtgtttgtttattttattttagttttcagataagcaaaccaaggcttagagaggacagagagcttgggttggcagtccggtgccacgcttaaacaaataggctcaaattctggatctgccgcttctcaaatcactgggtgatttgagcaaatttcagtctccctgagcctctgcttcttctatgaagtgggaagaaaagactattgatgacttagcatcaactattaggactagcgggaaggaggcatgtaaaaggtactacatgtatttaatgcagatttattgagcactcactatgtcccaggcaatgttctagttgctgtataacctggcttttttctgttgtggaatttctttttattcttattttttgattaaaaaattatttttatattttgtgggtacataggtgtatatatttatggagtacacaagatgttttgatacaggcatgcaatgtgtgaaaatcacatgatggagaatggggtatccatcccctcaagcattgatccttcctgttacaaacaatccagttatactcttttagttattttaaaaagtacaattaagttattattgactatagtcaccctgttgtgttatcaaagagtaggttttattcattcttttttgggggggtacccattaaccatgcccccgcacacaacccttcccagcctctggtaaccattgattgattgattgattgattgatagagacaaggtctccgtctgtcttccaggctggagtgcagtggcgcaatttcagctcacagcagcctccgcctctgcctcctgggttcaagtaattctcatgcctcagcctcctgggtagctgaaactacaggcaagtgccaacatgcctggctaattttttttaatttaaaaaaactttttttaatttaaaaaaactttttttaatttttagtagagatggtgtttcaccatgttggccaggctggtcttgaactcctgacttcagatgatccgcgcacttcagcctcccaaagtgctgggtttacaggcgtgagccaccgtgcccgaccaccatcctttacataaccttgctttttcccattgggtgagagatacagctaatagtcacagcaactgacctttatcaaatgtctattgtgtgccaagccactgtgtttatctttttttttttttttgctttttgagacggagtcttattctatcgcccaggctggagtgcagtggtacaatcttggctcactgcaacctctgcctcccaggttcaagcgattctcctgcctcagcctcccaagtagctgggactacaggcgcacaccaccacagccagctaatttttgtatttttagtagagatggggttttgccatgttggccagaccagtctcaaactcctgacctcaggtgatccacccaccttggcctcccaaagtgctgggattacaggcgtgagccactgcgcctggcctgtgtttatcttacacacatatctcattctaatagacagaaaccctaataagaggcaggtgctgtttttttgtttctttgtttgtttgttttgttttgttttgtttttgagatggagtctctctgtgtggcccaggctggagtgcagtggcacgatctcggctcactgcaagctccgcctcccaggttcaagccattctcctgcctcagcctccccagtagctgggactacaggcgcctgccaccacacctggctaattttttgtatttttagtagagacagggtttcaccgtgttagccaggatggtctcaatctcctgaccttgtgatctgcccgcctcggccttgcaaagtgctgggattacaggcgtgagccaccgtgtccggcaggtactgtttttatccctattgtgtcgataaggaaactgaggcttaaagagagacattgagtcatttgcccaaggtcgcacctctagcaggtgtggggctgggattcattccattatcccttacaacaaataattattgaacatctactgggccacacactgcactagaaacagagaaggcaacaatgagtaaataggtaggacaagctttctgtcctaatggcacttacattccagtggagacacctgcaccaattcctggtgcaactaagactttgttcggatggtggcggtgtgtgagggctaagggtgaggatctgacctggttgggaggagtgacatttaaactgagatctgcaaggtggggtgtgtgaagaatgctccaggctagaggccattttcacagtgtcctcactcctcatgcctgtccctcctgcctattcaacaacagcattggctccaaccctggttggtggtaacttccattctctgctttgccaatttgtctgacagccctgggtcctgacagatgtgttttctctgtaagagggattttgacatcatttcctagaatctttttcttgaccaaaggcttgtgattggcccttggcaaattgtaagactaatgacatttgtgtgtgtgtgtgggtgtcttgtagctgtaaaaatcccatcttcaattacatctcttcactatgccaattctctatccttattcagtgggcaagcaaagatggttgttttgagtgacaggaagaaaaactggtgaactcttggcgtgaaacctgaataaccctcttccctgcttaaccacaaacagagaaacccacttagcatcatggcggggggacaactgagttgtcaaacatgtgcaggagaattaatgagaccgtttttatgtttttccttggggaagaggaaggacaggcagcattctcagacctggaggactttgaattaaaaatgaaagaggcgtgagaattcttttcagttttttcccattcaatcctattacacattttatgacccttggcttgggggcccaattttaagcttgccttggctaagaactagggactcaagaaattaaagactcctcttccccatcctcccaggggctcttaatttggtgcaggaaataggtacgtttaaataagccactttaatacaaagtaaactgtgcttaggactcagcacagtgcctgccccatcgtgggcactgtattagccgcacctcttcagagaaccagaagaaatgaaatttataaaagaaaaaagtgtaggaagaaatgtattgtaaggattggcttacctgattatgagggatgagaagtcccatgatataccatctgcaagccaaagaaccaggaaagccagtggtgtggttccagtccgagtctcaagtcccaagaaccaggggtgcttatgtctgagggcaggagaagatggatgccccagctcaagcagagagagcaaattcactcttcctctgtctttttgttctcaacagatcggatactacccacccacattggtgatagtaatcatctttgctcagtctactgattcaaatgctaatctcttccagaaacactgtcacggacacatccagaaataatgttttaccagctatctgggcaccacttggcctgatcaagttgacacataaaattaaccatcataggcacttaataaagttgtgtggaatgattgaatgtttgcaggaatggatggatggatggatgggtggatggatggatggatggatggatggatggatggatgaaggaatgaatgaatgaaggtccatgagaaagtgccagacacttgggtgtgtttttagtgaagtatattgttaggagttttacggagaattgggggttgatgtatgcaggacttcactgagtgaaagagaagataaaaaaagagataaggggtcatggaaaaaccttaagactcagatttgggggcccaattttaagcttgcctgcatccccacttcccttagaatactgtggtgggtagggcaacattctgcagtgatgctcaaacttgagcgtgcattggaatcacttgggaggtttcttaaaacccagattggccaggcgcagtgactcacacctgtaattccagcactttgggaggccaaggcaggcagatcacttgaggtcaggagttcgagatcagtctagccaacatggtgaaacccagtctctaataaaaatttaaaaattagccgggcatgatggtgggtacatataatcccagctacttgggaggctgaggtagaagaatctcttgaacccgggaaccggaggttgcagtgagccagggtcactccactgcactccagcctgggagacagagcaagattccatctaaaaaaaaaaaaaaaaacacccagattgtggggccccaaccacagagtttctgactcagtaagtttagggtggagcttgagaacctgcatttctggcaatttctcatgcgatggtgacgctgatggtccaggtaccacacattgagaaccaccagccaattggcttagaacaaggactctggattcaaacaacttgagcttagggttgccaggtaaaatacgctcagttaaagttgcatttcacagaaacaacaaataattttttagtataagttccatgtcagaggcatcctgtatttttacttgctatgtctggcaaccctgttgggtttaactctcagtgctgttactctggagccatgctgtttaaggcccatcatttggctctccgagtttcagtatcccccacttacaaaatgggggtggtaacaataccagctgtctcctaaagtaattatgacgatcaagtaatcgtataaaggatttcacacagagccttgcctgtagcaagcacgcaggaaatgtcagctgttattattcaccattatcctcaggtgagtaacttttggggtgaaaaaagcattataccgagtgttttttttttgaaaggattttatgattcagccttttaaattttaaactagggaatatttctcctctttgaaaaggtccttgaagctgccctctctcatttctttaatagtagattataaagaatggattggttgattgcatctaaaatctcctcttccaacaactcccaaccccactcagggccagatttgactgatctctgggtggtgtatctgggtgttaaatttctgaggggccagtaaaggcaggtcgctgggggtagggctgagtcctgcctctaggaaataggcacagctcctttcaaactgctgcttgctatgaacaaaaacagaatgagggtcaggcgtggtagccagtaatctgtaatcccagcattttgggatactgaggcagaaggatcatttaaggccagaagttcgagatctgtctgggcagcatagcgagaccctctctctacaaattaaaaattaaccaggcatggtggggtgcacctgcagtcccagctacttggggggctgaggtgggaggatcgcttgagcctaggagtttgagaccagccagggcaacataaggagactccatgtctacaaaaaaataaaaagtcaagccacacatggtaatgcatgccagtactcccacctactcaggaggctgaggcaggaggatcacttgagcccaggagttcgaggctacactgagctatgatcatgcagattgcagctgcacatcagcgtaggtgacagagtgagaccctctctttaaaaaaccaaaaacaacaacaacaacaaaaacaaacagaatgagagggagagggagagggagagggagagggagagggagagggagagggagaatgctttttaatatagaatcaattcagggctgattctatcctttggaattaaatttttcccctcaatatttcaaacttatgtccattttgaggtttgggatccccatttcccctgcacttcatggaatgccagcccattctggaagttggagagccagtgagggtcagtgtgaaatgttcatgggcaggctgagctgtgctgggggctaagcgttggtctgaaatgcctgaacatttctttataaagttgaccacatcagtatctttcaacctgtaggttgtgacctgtaaatggatcatgaaatcaatttgaagggtcataagtagtattcttgtttttcaaaaagaaatagaatgcaacacaatggaattgaaactgtcaggatgcaggccgggaatggtagctcatacctgtaaccccagcacattgggaggccaaggcgggtggatctactgaggtcaggagatcgagaccagcctgggcagaatggcgaaatcccatctaccaaaaatacaaaaaaattagccaggtgtggtggcgtatacctgtaatcccagctacccaggaggctgaggcaggagaatcgcttgaatctaggaggtggaggttgcagtgagcagagattgtgccactgcacattccagcctgggcaacagagcaagactccatctcaaaaaaaaagaaagaaagcaaagcaaagcaaagcaaatatcaggatacattgcagtgcacatagtaagggtaaatgttgtaaacttttgatacatatgatatgtatgataaatatgtaacatacactatttacaggtgtaataggtcatggaatatggtcaaaagaacgtggaagtcatgagagcaggtaatagctaaggccccttgcaattttgcaatatggtgtcagtaagatggtggtttttaagcaggggcaattttgcttttcaagggagatttggcaacatctggagacgtttttgatagtcacgactttgtggagaaatcgtgtgctaccggcgtctaatgggtagaggccaggggtgctgctaagtgtcttgcattgcacaggacagtcccccaccacagggaattacccggccccaaatgtcaatagtgtggacgttgagaaaccctgctctaagggtacgtgtggatagaatcacttaccagtagtagccttattactactaactaggatttacggagcacttactatatgcaggcatgcttctaagtgctcacattgatgaactcttttaatacttacaacaggtgggagataaaagtgtgtttccttcccccttttcagatgaggaaactgaggcataggatgatcaagggttgcccaaagttacaaagttagcagaattaggattccagtgcaggaattctggctttaattccttgaatcagcgttttatgcttccatagcacttcagtctccaaagcctttttttttcctgtagcaaaacacatgtaaaatttgccatttcaaccatttaaaaatgtgcgattcaatggcattaagtatattcacaatgtcgtgcaaacccgttcaacaccaccatcaatttcaaaatttttgccaccccaaacggaagccctgaaccagttaagcagtcattccacacattctttcctctcctcggcccctggtaacctcccatcttttctctgtgtctatgaatttgccgattctagatatttcatatgaatgaagttatgtgatctgtggtcttttgtatctggcttctttctcttagcataatgttttcaaggtttctacatgacgtagcctgtgtcataatttcattccgttttatggctgatttatattccattgtatggatagatcacattttgtttatccatgtgtctgttgatggacactttgtttgcttccacattttagctattgtgaataaaactgatgtgagcccaaagctttttttttttatactgaaggtggagaaggattgtatcactgaggacaggggagaaatccagattgttttggtgacagacactgttcttagtcatctcacatatattatctcatttgatcttcacagtaaccccacgaagctcccccatttttacagatgtgaagaacagagagggtgagtctcctgcccagggtcacacagcaaatcagggcacattactctttgtcacgaagaggagaagtgtgtgtatattatgcagcagaactctgagcagtggctgccttctagaacaggagctgaacttctgatttgcacagaaatctagataggcaaaattccctcaatactcatattgcactatttctaggtgctgtatttagacatgtatgaagaagcctcaattgagaataaagatagttctccttgtgcaagaaaaaaaaaactacttttaatctctgagattcagtgccatgactttcactcattcttgatttgttgaggcttccttcacagtcaatttattccctccgtctgcattgatgaagaacttactatgtgcaaggcactgctccagacatgcaatatggcagtgaacaggacagaccaagtccctgtccatgtggagtttatgttctagtgggggagacaggtaataaaccagtgagcaaacacacaagtggtccagacagaggtgagggttaagtattgcaccttcctcttgaaacatatctgttggctctaacgacgtccacaaggagatactgaaccctgaggctggagggtaaactcagcttcccaccctcaactcactctgttcccaggaatgaccaagtgtttatcatgatgaattgagcgtaacatcttcccatcatccttggggtccctattacagacagagacagagctgaaagctagattcattcatatctgactttttccactcacttttttttctctggagtggagtctatttaggaaaacaccttcaggggtcaaggtgatctcctatatcagaaatcagcagactttttcggtaatgagccagacagtacatagtttagtctctgggtcacacggtgtctgtggcgccttctcaactctgttattctaacacgaaagcagccagagactatcagtaaatgaatggatgtgtttgtgttccaattaaactttatgaaccctgaaatgaaatttcatatagtttttacctgtcagaaaatattcttaataattttttcccagctatttaaaaatgtaggaaaacatccttagctagcaggaggagggctggacttgacctacaggccatagatcatcgactgtgcctgtatcattcctcatcaatggtcctctggcatctgaatctttccttttttaactccagccaacagactgcatcctaaggcagattattctgctttcagaaaggtgctgtttttagaaagcatcaatcatgtattgagtcaaaatatgccttcttgtatcattcatccaacaaacactttgtaaagaaatttaaacatttcaactttataggatggaagtttggggatatacataaagttagagagaacagtgtaatgaccctctaggtgcccatcacccagtactgaccattatcagcgcgtggccaatcttgtctcatctccacctgccaccctgcatagattctttgaaaggaaatctcagatctcatattactctatcagcaaatacttccatacacatctctgagggataaggactaaaacattttaaggtgacctgattttaaaattaacagtaattccttaaaatcattaatgttcagccagtgtctaaacttccctgacttatgttctttgattgttaatttctttcaacccagatcaaaataagatctgggcattgcatttagtcagtaaatctcttaagtcttctttttaaataataggtttattgaagtgtaatttggcacacagtatttaaagtgtacaatttgataggctttgccttatgtttataaccatgaagccatcaacacgatcaagataacatttccgtcaccccaaaagtttctctgtagccttttgaaattcctccttcccacctctccccacctcacctcacctacctgctagccccatgctgtcagtaatttgctttctgtcattttagattagtttatactttctagaattttatataaatggaatcatataacaggtactgatttttatctgaccttcttttataattataattagtttgagattaatccatgttgttgggtatagatagcttattcctttgtattgttgagtaacattctgttggatggatataccacaatttatctgttcatctgttggtgaatatttggatcattcccagttttttgctattataagtaaggctgttagaagaatgaaaaaaaaataagccagagactggaagaaaattttgcaaagcatagatctaacaaaagacttatatccagagtatataaagaaccctcaaaattcaatgagaagaaattgaacaacctaattaaaaatgggcaaaagatttaaacagctacttcaccgaagaagatatacagatggcaaataagcacatgaaaatatacttagcatctttactttgggaaaatgcaaaataaaaccggaaataagataccactattaaaatggctacaatataaaacgctgtgtcgggcacagcggttcatgcctcaaatcccagcactttgggaggctgaggtgggaggatcgtttaagcccaggaattcgagatgaacctgggcagcacagtgagaccttgtctctacaaaaagcaaacaagattagcccagcacggtggtgcacacctgtagtcccagctacttgggaggctgaggtgggaagatcacttgagcttgggaggttgaggctgcagtgagcagagattgtgccactgcactctagcctgggtaacagagtgagaccttgtctcaaaaaacaaacaaacaaaaaaacaaaaaacaaaactgaccataccagatattggaaagatgaggagcaatgggacctctcatatactgctggtggggatgtaaaatgatacagctactttggagaccagtttggcagtttctcagagttaaataaacactgtggtaggcagaataatgtcccacctcccaaagaagtgcatgtgctaatccctgcaacctgtgaatatattacatagaaaaaggagctgggcacggtggctcacgcctgtaattccagcactttgggaagctgaggtgggcggatcacctgaggtcaggagttcgagacgagcctggccaacatggtgaaaccccgtctctactacaaatataaaaattagccgggcatggtgggatgtgcctgtagtcccagctactcgggagggtgaggcaggggaaatcgcttgaatccagaaggtggaggttgcagtgagccaagacggcaccactgcattccagcctgggcaacagagagagaccctgtctcaaaaacaaacaaacaaacaaaaagggacattgcagttgtgattaagttaaagattttgagatgggaagattatgtggattatctgtgtggtccaatgtaattataaatattcttataagaggatggcaggagggccagagaaagaaatatgaagatgctacattgttgactttgatgaggaaaaggggccatgagccaggaatgcaggtggcttctagaagctggaaaagacaagagaatgagtcttctctagagctttcaaaaggaatacaggtctgcctatgccttgattgcagcccagcgaaatgagttccaaatttctgacctttacaactgtagcatagtaaatttgtattgttttaagccattaagtttgtggtaatttgttacagcagcaacagcaaactgatacatattcctacatataatcctgccatctcatttctaattatttatccaggagaaatgaggacttacgtacattagcacataaatgcttctaaatctcttaatctgttagaggtccctctttctcatggatttctgccatttataacaaacatctgttgagtgtctactgtatccctgagcctactctttagagagatacagtaaataatactatttttctttctttcttgttttttgagacacggtcttcctctgttgcccaggttggagtgcagtggtaaaatcatggctcactaacagccttgacctcccaggctcaagtgatcctcctacctcagcctcctgaatagctcggattacagtcacgtgccatcacgcctggctaatttttgttttttttgtagagacggggtctcactatgttgcccagcctggtcttgaatgcctaggctcaagcggtctgcctgcctcagtctcccaaagtgctgggatcacaggcgtgagccatcacgtttggcctatttatctttctttatggcgtgttttttaggtggttcacacaccgtgaggttccttccctgacatctagtttaaacaatctctgttcttccacacagtctgagtgtgtgaaaattcctcttaagggactgtgatacagagaactgtacttagaaatgcaatgcgatttgcttagggtggttcaggatgttatgtgaacctctgttttttatcttcccaggatccttcaacatctctggacaaagtcatcccagctttaattgggagcaccatcttccttcagtttctagattatgtgactttgttgtgtctgtgactgacctcactccatgacaacagggcagtcacatgtctttggctggccaatcagggaacaccattgccctggccccaagagactggttcagtgatgggcacttggctcaagctggatcattgtagaaatccctgggctgtcaatcactcctcaacaggttgctgggtaagcacaacatcagagtaaagggaattaggtgatcctcaaagatgttcactcatgctggaaagacaagacaagttggcagcaaattcttctaaagggacacatatctagttttgtgagagaggcagtgtttctcatttggggacattttggagactcttggaaaaaccctggcaatatcaatgcttttgctcagctttttgagtggtgcatggagacacatggcctcagtgtatcagttggccgggctactggcaaggaattgggattggctttcagcttgttgcatgtgccctgcttagctttctaagcttgaacctgatccttccttacctatccaactgctactgtcactctttcctcccttaaatagaactcatctctctgctttatcaaatccacaaccctgcgaatccctgatcagctttgttttcttcactgagagctttctggcttcttcggtcttctaaccagattgcaattaaagacagaaatcatggcaaatacttatttcttactgtttcctgtttctaccctggtctttccaaccacattttaggggctgtatatcagatgtgcctcttgtttatatagagagtccggtagtcatttgataaatgtctgttgcgtgctgagattcgagatggacaaggtccctgccttcgtgaaggttgcaatatagtgggtgggaaaatacaataaacaagtaaatagatactatgtaaggatgaaaacaagaacaagatcagataatgggcaatgggaagagaggaaaccctaataaggtagccaaaggaggcttctttgaaaagatggcatttgagtagacacttgaatggactgactggcttctctccctctttttggtgttagcttggtggcttgtgataaaaacaatggacagtagaatttttaacttccttgctttctgtgcttttttgccaaatctcttccaaattgcctgaaatgatccaacagaccacagtagacacagtaagagagcccctcaagaattcctacatcctgatattcatgctccatggaatccctacaccttgagtgtgggctggatttattggcttacttcttgcaaatgaaatatggcagaagggaggtcaggtgtggtggctcacgtctgtaatcccagcagtctgggaggccgaggcaagtggatcacctgaggtcaggagtttgagatcagcctggccgacatagtgaaaccccgtttctactaaaaatacaaaaattagctgggtgtagtggtgggtgcctgtaatcccagctactcgggaggatgaggcaggagaatcacttgaacccaggaggcagatgttgcagtgagtcaagatcatgccattgcactccaacctgggcaacaagagtaaaactccacctcaaaaaaaaaaaaaaaaaaatggcggaagggatgagctgtcacttcaacgtttacatcataaaatgaccatggcttctaccttaggtattccctgtcttgctttctcttagatcactcactccaggtgaagccagattccatgtcatgaggcaggtctgtgaagagacccacgtggcaggaacagaggcctgtggcctgcccaaatccacctgcgtggctttgaaagtgaattctctcaagttgtgtcctcaagcgaaatttcggccctgacaactgcaactgcctaagtggccttgagccagaggcacccagccaagctgctcctaaggtttcagacccacagaaatagtgagataataaatgtttgtattttacaccattacattttggggtaatttgctacacagcaatagataactactacacagtcaaactggaatgatcatctatgggtctgtatgggtttgcctctctctactgagtggggcagatggccatggtatccagaaaaatactcttccttagataaaataggcatcccaaggccttttcacactgggtcataaatgtacatttagtggatcatttccatcactaaaatgtaagatccacaaggaaacttgcatacttgtaataactcatatactgtaagcccgtgtccagcatgtagttaagcattgtatgttcaccgacttcctttatctttcgaacaatcctatgataaatgtattattataatcgtcattttgcagatgtgaaactgaggcggagaagaattaagttgcccaaagtgatgtcatgtgtaaatggaggaggcaggatttgaacccaggcagtttggcttcggagttcttaataaatatttgggttggagtaaatgagggagtaaaactgtgggatgactcctgtccttcatttcttcattggtgttttcgtaaccccttgtgtggtatttgttgtcgacatcttgctgtctaaaatatattccgaaagcatcctgttcctttttcatctcgctgttttctttgctaagcccttcacaggaggctgggcctttctctctgtgttgggatcttttatattttaagatattctcttcgccaagcatgttgacatgtgagttgcaagcaaagcctctgagaagcaaaatgttgaacaattatcagttgaagacatcatgtcacaatgaacttctctttaaacaaataaaaaagtcccatagcaaactccttttatctgaggatctccaggggcccctctgacactggattgtcacaccgagacatttcaaacacagactctcatcatttagtctggttgctggggccccagacttctttagaatagataatgcagcttcattacggttctgtgtgaatgtgcctggaaaaggatcattgcatttcttttaaaaagcgttggcattttttttttccttccagccacttaattgggattgtgatgtgaaaaaagaagcatagaacaaaacttccaataaaaaaatttggactcagtctccataatgtcatccaggcttgctttggccttgatgaattcagcacttcagagggtatgtcaacacaataaattttatgccctcaataaaacttgtgagtgagctcagtgagaaattccaaggtctgggaagacaattaacgtttgaaatatatattgagttgtgtactgcgacattttatgtggccacagagctgtacccgatgtcacaggggaaaaatttccctaggaaatgcaaggtttgcttttcaaataacattgacatgtcagattcctccccaaatacagaggaatgtaagaaatgactaccaatgaaaatccagtgacattctctgaccacattgatgtgattctccttgttttccatttcaactggcagttgtcttcagagtgtatctgttgtcaacatctcagcaccttaattttattagactatttatatgactattctttgtagttctgtgtgcatgggggtgtcttattaattgatttgactggagttcaagccccagccctaccttttagtcaatgtatgatgttatacaaattgtattacctctctggactttattttctgttgtgagaattacagtcatgcacagcataacaacgtttcagtcagtgatggaccacatggacaacggtggtcccacaagattataatggggctgaaaaggccgggtgtagtggccaagcctgtaatcccagcagtttgggaggctgaggtgggcagatcgcttgaggtcaggagttcgagaccagcctggccaacaatggcaaaaccctgtctctactaaatatacaaaaattagccaggggtggtgggcacatgcttgtcccagctactttagaggctgaggtgggacaattgcttgaatctgggaagcagaggttgtagagtgagccaagattgcaccactgcactccagcctgggcaacagagctgagactccatctcaaaaagaaaaagaaaaaaaaaaatggggctgaaaagttcctatcacctagtgatgtcatacatagccatggtaatgcaacacattactcacgtgtttgtggtgatgctagtgttaataaacctactttgctgccacttttataaaagtctagcacatacaattacgtacagtacagagtacttgatgatagtaaaagacaatgttactggtttatgtatttaccatcctatacttttatggttattttagaatatactcctatgtatttaaaaaaaaaaaactgtaaaacagactcaggtaggtgctgcaagaggtattccagaagaaggcgttgttgtcataggagacggcaggtctccatgtcatggagatgaacacatgcctgttattgcccctgaagaccttccagtgggacaagatatggaggtggaaggcagtgattgtgatgatcctgacccagggtaggcccaggctaatgcttctctttgtgccttaatttttaacacaaaagtttaaaaagagaaaaaaaatacattttaaaagtagaaaaaaaatatagaataaggagatatttttatacaactgtacaatgtgtttatgttttaagctaggtgttattacaagagtcaaaaagttaaaaaaattagtttataaagtaaaaaagttacagtaagctaagattaatttgttattggggtaataattttttttcttttgagacaatgtctcactttgtcacccaagctggagtgcaacggtgtgatctcagctcactgcaacctctgcatcccaggctcaaacaatccccctgcctcagccttccaagcagctgggattacaggcatgcaccaccatgcctggctaatttttgtattttttgtagagatggggttttgccatgttggccaggctggtctcgaactccgggactaaagaaattcacccgcttcagcctcccaaagtgctcacaggcatgagccaccatgcgcagctagaaataactttttaaaaaataaatgtagtataactcaagtgtacagtgtttatcaagtctacagtagtgtacagtaatgtcctaggccttcacattcactcaccactcactcactgactcacccagagcaacttccagtggtataggctccattcgtggtaagtaccctgttggggtgtacctttttaatcttttatactgtatttttactatagcttttctatgtttaggtaaacaaatgcttatcactgtgttacaattgcctgcagtattcagtacggtaatatgctgtacaggtttgcaacccaggagcaataggctatactatatagtttaggtatgtagtaggctataccttccaggctcatgtaagtatactctgtgatgtttacacattgacaaaactgcctaataatgcattttccagaatgtattcttgtcattaagctacgaatgactataaatgcaacaacaggttatcatatagtctgttaattataatttaagaagtcgctatcatttctttgtgtaagattaagctctctttgaggagggtgctaaggcacagattgtgagcagataaaaaaatgtcagttaacatgtattagtcagttattgctgcctcaatgctgtgtgacaaataacctcagaatttcattggtttacaacaatattaattaaatagtatatttgtcatataaatttacctacttgtttatttttgctcataggcctgtgggttagtcaatacagctcagcttcaggctgcaaattgggtttaggtctactccctgtgtaccacccggggtgtgctctttcatgggcaatgacagtggtgccagaacagcaatcagaaacatgactgggcgcggtggcgcatccctgtaatcccagcactttgggaggccgacaagggtggatcacctgaggtcaagagttcgagactcgcctggccaacatggtgaaaccccgtctctactaaaaatacaaaaatgagccaggtaaggtggtgcatgcctatagttccagctacttgggaggctgaggcagaagaatcacttgaacccgggaggcggaggttgcagtgagctgagatcgtgccactgcactgcagcctgggtgacaaggcaagactccatctcaaaaaagaaataaaagagaagaaacacaggatgcctcttacgttgtaaactctaacccacactttgacaccttttcctacatactattggccaaagcaagtcacatcgtcaaaaccaatactagtggggcagagaagtatagtccatttagcgtaagagacaagacagatttggggaaaaataatgtcacctaccatgcaaagtaagaagaggtaaagaatctgagaccacttatatatacaaaaggtacccaagaaacatacagttttctctcttttggattcatatctcaaatcttttgaattgaccttattttctacaatccaagtaaagattgagttctttcttttccttctatttgacaaaatcatagatttgttccaccagtgactcatttttcctttcagaaaatcatgtactttttattcaaggtctccagaaactctttggctgaaggtgaaatgtgtattgatattgactcatctttaaatgtcaatgaccagtcaagataattaaggagttaagtattggttgcagagaaaagggaacgcttatacactgttagggggagtgtaaattagttcaacccttgtggaaagcagtgtggtaattcctcaaagagctaaaagcagaactaccatttgacccagaaatgccactactggatatatacccaaagtaatagaaatggttctatcatagagacacaggcacatatatgttcattgcagcagtagtcacaatagcaaagacgtggaatcaacctaaatgcccatcaatggtagactggataaagaaaatgtggtacatatccaccacagaatattatgcagctataaaaaagaatgagatcatgctctttgcaggaacatggatggagctggaggccattatccttagcaagtgatgtgggaacagaaaaccaaataccacatgttctcacgtgtaagtgggagctaaatgatgagaacacaaggacacacagagggaaagaatagacactaggcctacttgagggtgaagggttaggggagggagaagataagaaaaaataactattgcatatcaggcttagtacctgggtgaccaaataatgtgtacaataatcccctgtgacatgagtttacctatgtaacaaaactgcacatgtacccctgaatctaaaagaaacgttaaaagagtaaagtgttggccaggtacagtggctcacgcctgtaatcccagcactttcggaggccgaggcggatggatcacgaggtcaggagatcgagagcatcctggctaacacggtgaaaccccgtctctactaaaaatacaaaaaattagccgggcttggtggcgggtgcctgtagtcccagctactcgggaggctgaggcaggagaatggcgtgaacccgggaggcggagcttgcagtgagccgagatcgcaccactgcactccagcctgggcgaaagagcgagactccatctcaaaaaaaaaaaaaaaaagaaaaaaaaagagttaagtgtttactcatctattcaaatcaagtgacactatggtgtgcacgagactggaaatcaggaagaagtacaagattctagtctcagctctgtcactaagtgtggacaagacagtgatgttctctgggggtaatctacaagaaaaaaggctgaggaagccacagggcaaatcatttaatgacgttaactattttcagtaatctctcaatgcagaagtcatcgtctaaataagcattcctttccaaatgcagtctagctattttgcctaaaagttggcagatgtgacttgccccagggtagagaacatcttaagaaagatattttaaatgtggtgtttaaacaacctataacaattatgcaggggttttttaagttcatataacaattctactgctttttgctcattcattgtttctgtttttctcattgttgatccagtaatttcacttttaaggaaatagagatgaggaaaaaggtttatgtacaaaaatgttcattgtggtacttaaaaaaattaaagtaaaaaattggacagaacttaaatgtctaatcataagggactgattgagtaaattattgtaaatctatttaatggactataatgcagatgttaaaatcatgttttaaaccattttaatgacttgacaacgttcttatggtataatattagatgaaatatgtaaaataagaaaagcataatattttatgaccatcaattctttaaaaatgcaataataagtttgtaaggaaattcagaggaacaggaatggtgattatctcaggattgtgacattctaagtactttgcatgttctttacatttttctacgttttctatttttgacaacaaacattattactttttttgggggggggggcgacagagcaagactctgtcttgctggagtgcaatggcaggatctcggctcactgtaacctctgcctcccaggttcaagtgattcttctgtctcagcctcccaagtagctgggattacaggcacatgccaacacgcctggctaatttttgtattttttgttagagacatgttggccaggctggtcttgaactcctggcctcaagtgatccacccgcctcggcctcccaaagtgctgggattacagttgtgagccaccacaccagtctatttttcatttttgttaaagtaatacatttacatacacacataggcatgccctaccgtttttacattctgggttcaggattcagggtgtcagaggaacaggaattccagtggaggtaagctctgatctggggagagactctggggacacgggtgtgctcattcctggatttggggtcatcctgtttggatggctcccagagggaattaagaagcctttggcagaaccacttctgatcgagacagacaggcagtagtctttgaacccaagcactggcttacaacttggacttgatgaaggcattacaaaatcactttatattgctcattctttccagcaacttctctgtgaattctagttggaggaaaaaacaaacaaacaaaaaacaaacacagactttagacacaagacgttttgcagcctccagatctgctcacactttgccaccggtgtctgtaggggataaagtcaactctgcagggttggcaaatggcaagatttgcatacacccagaaatcaccattgtgatcttcgtttagacagcagtgcccccagaacccgcctgctagccctattctcccaatgacatataggagagacttccaaagaggtttgggtctgaggtcacaagtggttttcatactgaaagtaattttggtggaaaggagacggcttcaaaactcctgatgctctttattgtcttcaaacagcttaaacagaatgtgcaggaaatataagctcctccctttaaaacactgaccttttttcacattagtttccctggaagtttgaacaaagaatcagtgggtaaagaaaatgatttgggatcccagttgtacagcgggcattttttgaagtgttttatcatcttgccagagtggatatgcttggctggagttagagcccgccagtgaggatctcaagctcaagaactcaacactcctgcctttctagggtttgatttactctaacacatacgcactgccaaggtcattgccaccctttagaggatgatgcgacaatatggtgtttaagacaaacttgcaaataggttaccagcccatggaagaatttatttttatttttattttttaaccagactcaacctggtttgtttgtttgtttgtttgtttgttttgagacggagtttcgctcttgttgcccaggctggagtgcgatagtgcgatcccctttcaccgaaacgtccacctcctgggctcaagcgattctcctgcctcagcctcctgagtagctgggattacaggcatgcaccactgtgcctggctaattttgttacttttagtagagatggggtttctccatgttggtcaggctggtctcgaactcccgacctcagatgacccaactgccttggcctcccaaagtgctgggagtacaggcgtgagccactgcacacagcccgccttaacctgtttttaagataaacccaggtacaaacatgcaataaagcaacattcctttgtttcctcaacgtgaagctcagttgtgacaaggtgctctattgttaccacaaaggggtcccgatccagattccgacaaagggttcttggatctcacacaagaaggaatttggggcaagtccatagagtgaagtgaaagaaattttattaagaaagtatagaacaggttgggagcggtggctcacacctgtaatcccagcattttgggagactgaggagggtggatcacttgaggtcaggagttcgagaccagcctggtcaacatggtgaaaccctgtctctactaaaaatactaaaattagccaagcatggtggcaggtgtttgtaatcccagctactcaggaggctgaggcaggagaattgcttgaacccgggaggcagaggttgcggtgagccgggatcgcaccatcgcaccccagcctgggcaacaaaagtgaaactctgtctcaaaaaaaaaaaaagtaagtaagtaattaaagaaccaagagaatggctactgcataggcagaatagtgacgtgggctattcaactgagtatacgaatggtaatttcttgattatatactaaacaaggggtggattattcatgagttttgcaggaaagggacaggaaattcatggaagtgaggtttcctccctttttagacgacatagggtaacttctagacattgcatggcttttgtaaactgccatgagactggtgggagtgtcttttagcatgcaaatgcattctaattagtgtgtaatgagcaacgaggatgacctgaggtcacttttgttgccatcttggttttggtgggttttggccagcttctttattggatcttgttttatcagcagggtctttatgacctgtatcttgtgataccagtcctgccgacctatctcgtcctgtggctaagaatgcctaacctcctgggaatgtaatccagtaggtctcagccttgttttacccagcgcctattcaagatggagtcgctcaggttcaaacacttctgggaagatcacacattttaactaggtccctgttgtgcactgaattacttaggagatcatcaggggttcctaagatggtctcaggtggtagaaacttatgagcgagaggataaactagaagagagtaaaaaatattactctgtggtgggagaacagggaattagggtaacggaggttcagcaggtgcagccagttcacataagcaaaagaacagcaggtccagccagtttgcataagcaaaaaaacagcaggtgcagcacataggccacatccttgctcccatgataacaagccacttcagcttcccattggtcacgggccagtccttcaaagggtgtaaccaactggagacctctaaaaggcacctaggggtgttgccaagttcttttggctttataaaaactcttgggaggattgcagtaagcaggcacttgagttgcttgttcgagcctgctctctgtgagttgtgttcaatatctctgcccatcgtgtggcattttgttcaattccttgtccaatacgccaagaacctggacaactcacgattaggaccttctgataacatattttggcgaaccagtcaggaggtaagacaatattttgggactttttaatattcctcttctctgagtggggcgagggactctcatttcatgtatgaattctttatgcataagagcgtggaattttccattgtttgtagggataaaccccataataatttcacagtacattgcaagattgcttgtttcatgagtttcaggccgaagaagcttatttcacttggtgagacgcaaagagctgagcgttgcatccgttgaccaagggaatcatagaccattccattgcctatggaggaaaaacatcctcagagatgcctgaccccctagggtcagaggcatcagcaacagataggccctccttaggccagatcactatgggaaacaatattcagacgagttttcgctagtaccaatagacgcctttgctggcttggttgaagcctaccctaacagaacagagaaggctaagaaggttataaaggttctcttgaaggaaatcatctcctggtttggattaccccaaagcctccaccacaaagtctccaaagtaataacagcccatcttttatctcccaaataactcaagcggttgctaaggctgttggaatacaagctacttcaggccctgattgactgcgggccaggtctccacttcagcctctgattggtggcaggccaagccttcatggggtgtagccaactggaggcctctaaagggaccgaggggtgttgctgggctctggcttcatgaaaactctaaggaggctcttgagccgcttgctcaagccccctcccactctgtgagctgtcttcaataaatctgtgctttcatcactccattctgctgcgttgtcctccattgcttcgttcttttgttactgtctgtgttgttcaatacgccaagaacctggacaactcgatccagtaacccttcgtactactatctccattactaccatgataactactgttgctgctgcttctattttattactctgactgccgctacgttactactattactacctttagtattgctgctgctgctgctactattactattattgccaccactacttttggtattactaccactaccgtgatggttactgctcttactgccgcggctaccagcagtcgccgttttatttttaacacctcctgagtgcacatcagtttatatgtgtgaagtcacttaatacaaatgccggccaggcgcggtggctcgcgcctgtaatcccagcacgttgggaggccgaggcgggcagatcacctgaggtcgggagttcaagaccagcctggccaacatggtgaaaaccccgtctctactaaaaatacagaaattaggcgggcgtgatggcacgcgcctgtaatcccagctacttgggagctgaggcaggagaatcgcctgaatcccggaggtggaggttgcagtgagccaagatggcgccactgtactccagcctgggcaacagagggagactctgtctccaaaaaaaaaaaaaaaaaaaaaaacctgccaaccagtgtgaggaatactaactctgttgttcagatgaagatcttgaggctcaaacattatggtaacttgtttaatatcacccagtgagtgacagaactggggtgtgaagccagatttctgactctatttctcaaccaggatgctctactgggggtggcggtggggagagaagaaaaccatagcagacgattcacctgctgaatggctgtaattcccatgtgaggagatatgaatagtgtgaaatccaacaaggagacccttgttataaggatgcaggtacagggcgccctccccttctaagcttcctggctagatctcttgctttttctctcatgcattcacacttagatatacacacagcatatctttgagcatacaatttcacttagctgacctattttattttaaagaggaaatgagctaatgccctagatttcagagaagactgacatatccccgtttatctttctgctcactgctgttattctaaatcccaaacctaagtcgacaggttttcttaataggctagggtaaaggaaacctgggggcttctctctgccttcccctctccttccccatcctagcctcaacatttactcattatccatttgctgccaaacagagctcaaaaaagggagatctgctaattatttcatttgataaacacatggattgagtgcctaataatagctaatactttttgtgctttaaccataagctaggcctttgcacatataatgcatttcattcttacaatggccctatgagatgagaccattatcatccctttagagaggccagacaatgaaatctcaggttaagcaactttcccaaggtccctcaactttagcagaattagggcttcactacattgtgcaaaataatgatttggaaacagtttcatgccatgggagataatatacagataaataaggctcaactccttgtgtcaaagatgctgaaagcatggttatggctaaagatggggaaacaagcaaacataagcttgaacaaaggacaagggtggactagcaggttgggggaggagtaagaaaaagggctgaatctgggctgcataggaaactaaccagcttcgagaccctaacttgtatagtgggtttcagtgttgaagggccagtgagtttgaggcagaaataggcaggacagaggggcctgcagactgattgtatacaatctgctgctgcagtattcacaataccaaaggcaggaatcaacccaggtgcccatcaatggtagactggataaagaaaatgtggtacatatacatcatggaatactatgcagccatgaaaaagaacaaaatcatattctttgcagcaacataaatacagctggaggccattctcctgaatgaaataacacaaacggaaaacacaaaatactgcatgttctgacttataagtgggagctaaatcttgggtacccacagaaataaaaatgagaatagacactggtgactccaaaaggaggaaaagaggggggcaaaggctgagaaacttattaggtactatgttcactatctgggtgatgggattaatagaggcccaaacctcagccttgcacaatatacccatgtaacaaacttgtacgtgtaccccctgaatctaaaatcaaaataataaaaactgctacagtttgaaatgggccagctccaagtctcaccctgggtgctatattttcttcaatataatgaagtgctgcctgtacccatgtgcaaaggagaagtaaagggcaacagctctttgtcttagcccagaaacctcaggatataagccctgggaggagacagtctttagtaagaagaccctcacagaggtctgatgagctacttcaaattatacctggcctgtgcttgcttttgaggtttgaataagagttaattggctgggtgtggtgcctcacacctgtaatcctagcactttgggaggctgaggggggcagatcacctgaggtcagaagttcaagaccagcctggccaacttggtgaaaccctgtctctactaaaaatacaaaaattagctgggtgtggtggtgggtttctgtaatcccagctactcaagaggctgaggcacaagaatcgcttgaacctgggaggtggagattacagtgagccaagatcccaccactgcactccagcctggaggacaaagctagactccgtctcaaaaaagttaagtcaaaagggaaagttgcatcaggcagaagaaacagattaactccatgccccattatttcccctatgtcagggatggagggaatagtacctttctcttcttgtcttcctatacctatctgccttctcttaccctctctacctattcctttcttcactgcttttggagggaatggaatgccagctaggtttgtttgagacattgtttaccagtgggtggcgatgctactgaaaaactgggggtttggtctgggtcctgttgctcaccacacagaaagcccatcactgagatgaccagtattgctaaggacgaaagctttgatccagtgccaaggagatgggaactcattctcaaacccatctccctgaccaatgaaaactaaggggtttatatagcagggaagaaatgtaacaatgtgtgaaaaagcagttatagtgaggggcaaggaagcaatctcatgaatgagggatcccacattttgctgtctgaatgtggtgatctggtgagtttcagttctttaatagttttttaaaaagaggcctgaaggtcttttcctgaggaagaaactcagataaaagaaatgtaagagtggggcctggtggctcatgccagtaatctcagcactttgggaggccaaggtgggtggatcacctgaggtcaggagtttgataccagcctggccaacatggcaaatcccacctctcgcttgaacctgggaggcagaggttgcagtgagctgagattgcgccaccgcactccagcctgggtgacagagtgagaccctgtctcagaaaacaacaaatgtaagtttcaagctttaagaacagaaggatcaatttctgtgtttatccaaaaaaaactagttgactattgggtcagtttcagtgatgttcataaaaagctcagacctaacccttttcattcccctccctctctggtttttctcctacaccatctggccagctcccaaactaaggtccttattgtaccctggccacgaaaagcctgagcgtgaagatcattgagtgtgagggcatcttgcagccgcatagaaggtagtggggatccaagtgcaggatttgggctgaggtggggcctccagacccttgcagtaagctccaactgagccatgtcagagctctgcactggggtcaccaggtcaagctgttgataaaatggtgctttgatgttttcctgcaaaccttccatatccagtccccttgggaacattcagggtggccaggatgactgttgacagcacatgaaaactttcccttgatttttattttattttttattttattttaagacagagtctcttgctctgtcaccaaggctggagtgcaatggtgcgatctcggctcactgcaacctccacctcctggattcaagtgattctcctgcctcagcctcctgagtagctgggattagaggcacctgccaccatgcctagcttatatatatatatatatatatatatatacacgtgtgtgtgtatatatatatatatatacacacacacacacacgtatatatatgtgtacatatatatatatatacacgtgtatatatatatatatatatatatatatattttttagtagatatagggtttcagcatgttggtcaggctggtcttgaactcctgacctcaggtgatccacccacctcagcctcccagagtgctgggattacaggtgccagccaccatgcctagttacgttcccttgatttttaactttcagcatcttcccatccttgtatcttttcttaatcttctgggtcattctctcttcctcattatccatcaagattcagctcatctgctgttctttttccaattccctctatgaaaaaaaaaatgagaaatcccctcctcttgcctgtaagctctaatggcactgttgtagctttttgtttctgtcattgccttgactggtttgtgagcttcctgagaaaagattttgtgtatctgattcatctgggggtgtccagtgcttagtgaattgcctgtcattaaataattcattcattaaacaaaaaatgtaaggggtgcctctatgtgccagatgctatgttagagtctgggatacattaataagttccctgtcccaagaaacttggagtctagtgtgggagagaggcatcagtaaaataatcacacaaatacatttaaactgacacctgaggtacataagcctttgaaagcacatgggaggggactagagcttgttggaaaggtcagtgaagcctcaggaggaagtaatgttagagctgagatctgcagggagagtggccctaaccaggtgaacattccaggtagaagaaacatggtgtaaagccccgggctggagatgagtacagcatgctaggggaagtgagagaaagctcactgtagccaaagcaaaaggggctagagtcaaagagagacaaggaagtagtgcttctgtgtctcagaagctcagaattgatgagccgtggctaaaagatgggtcttcatcccacaattgtgtgctcggcacaacataaggggctccctgaatctcctcagattcctgaatgctggaggctttggtcttccacacagataaactggcccctttctgccctcatggcatgtgcattaatgatgtgggtgtggatcagtgtttttacaagttggatcacccggaccaccctgggatgcagcggaagatgtgacagagaaaagtcgatcatgagggcgtctttgtgtagcctgttccaggagagaaggaaatacaatccagaactggaatgtctttcaatttccataagcaaatggaaaggatcttaattgagccaggatatcttcagtgctgtgcctgttttcatgatgctgttctctttcctggatctctgcccatgagtgtagggtgttctgtctggcagagaaagcatctcatacaaggagccctcatacaagctacataaaatctcagtggtctcagagctttagagtaaaatgggagaggaagatagacattaaagtaatgatatccaaataattatttaaaattgcatttggcataaacactattacttattttttgagagatggagtctcgctctgtcacccaggctggaatgcagtagcatgatctaggctcactgcaacctctgcctgcagggttcaagtgattctcctacctcagcctcctgagtagctgggattacaggcacccaccatcacgcctggctaatttctgtatttttagtagaaacgaggtttcattatgttggccaggctggtcttgaactcctgacctcaagtgatccacccacctcggcctcccaaaatgctgggattacaggcgtgagccactgtgcctggccatgtttggcataaatattataagaaagaagtacagggcactgagacatatagcccagtctggtctcggtgtctgggtagagtgatgccattttctgcaacaggaaacccagaaggatgaccaggtttggagcacaggatcagatccctgcccatgagcactgggttttctgtctggcagagaagggaacccatacagggggccctctctttggggcaaactgcccctacctcccatctagatattttatgaagagctctagttactgcttccaatctaatatcacctctgcaagaagaggttgagaaagagggaggaaccaaggatgacttccttgtttagggccaagtgactaggtggatgttaatggcataaacacaagaagaggtttaggggagaaaccaataagctcaatttttgtcttgatttgtttgaggagctgaagaacatccagttggatacccaaaaggtagctggagatcggagcctgggcttgagaaagttgggtgcttgaagactcagaaatgtttgagcaactttgtctaggaaacctttctcttcttggaaacagccaatttcccatctttaaaatctccctggaagataggtagaaatacctagtaccagccgggtacagtggctcccagctataatcccagcactttggaaggctgaggcaggtgaatcacctgaagtcaggagttcaagaccagcctggccaatatggcaaaaccccgtctctactaaaaatagaaaaattagccaggtgtggtggcgggcgcctgtagtgccagctagttgggaggctgaggcaggagaatcacttggcggaggttgcagtgagccaagatggcaccactgcactccagcctgggccacagagtgactctgtctcaaaaaaaaaaaaaaaaaaaaaaattcctagaatacagcccacagctccaaattacatttttaggcagttttcacaccatcctaaagaaaaagtcaggcagcctagacaaaggtattcctagctgcccacacaatccttctttaccttcttctgctatgtcatcaagccaagcagcacaattatttttctttcatatcatcatggatttcaatttttgtaacttctttaaaatttctaatagagctctttcatgtatccattcattcattcaatgctgtgtgccagtcattgaagaaaactacacaaaatctcagtggccttagagcttagagtcaagtggaagaggcagacagacattaaactaatgatatccaaataattattttaaattggcattgtcataaatattataggaaagaagtacagggcactgggggatgtagcccagcttggtctcaggtcttggatagagaatgatcagtttgctgggatgggaaattcaggaggaagaccaggtttgggtgtagaggggctttaaaacggtaaataagactcaaacactagccgggcacagtggctcacacctgtaatcccagcactttggaaggccgaggcaggcagatcatttgaggtcagcagttcaagactagcctggccaacatagcaaaaccccacctgtactaaaaatacaaaaaattagccagttgtggtggtgcacgcctagaatcccagctactctggaggttgaggcaaatcaaacacctgtggaactcactatgtgcactgggcaccattctaagcaggtttcaaccatccgctcatataatccttacagcgatcttatgaaggagggaccagcattatccttattttacagatggaggcgccaaaggggctaacatgtttttccaagtctccacaattaacaagagacagagccaggatatcaaatccagacagactgccagaatccaccctctctaccactgtacatgatacaggctctctctgggggacttacctagatgtgttcatttgaagattctggtgacaattggataaacactttccttatcattttaaaccgtttgagctgggatttctgttatttgctggcaacagatacaaatgtgaacggacgtctgaagttgtaaaattcaagagagaaggctgggctgggttcaatctaaggaaaaccttcacgttttacctccggcaatgcattctgggctatcctcttctcagtagtctttcatcttgaaaaggtttccttgaactgtagcctcttctgaaggacaaagacatttagggcatgatttttttacaaattaaatcgagactgggttcagtggttcacacttgtggtcctagcactttgggaggctgagattgaaggatcccttgaggccaggagttcgagactagcctgggcagcataatgagaccctgtctgtacaaaaaattaaaaattaggtgcggtggctcacgcctgtgatccctattacttaggaggctaaggtaggaggatcacttgagcccaggagttcacagctgcattgggccagggttgagccactgcactccagacttggcaacagagagaccctgtcttaaataaaatccaaaaaaaagcaactgcctactatggcggtaataccatccattcacagagtcctgtcttcatcttcccatccatacacagatatgtactttttgtttttttttttttttttttggagacagagcctcattctgtcacctaggctggagtgcaatggtgtgatctcagctcactgcaacctctaacctctgcctcccgggttcaagcaattctcttgcctcagcctcctgagtagctgggatcacaggcatgtgccaccaagcccggctaatttttgtatttttagtagagatggggtttcaccatgttggtcaggctagtctcaaactcctgaccttgtgatctgctctccttggcctcctgaagtgctgggattacaagcgtgagccaccgtgcctggcccagacacgtacatgttaagacccctgaaacaactttatgtacaagctaagtttgacacggtgatggatgtgaaacctggcaagtctgaaaggcaggaaaagccagcagagcggaaactgcttgcagcgtaacagaagcaggaagcttggtctgcctgtcttgggcatctcacgcctcacttgccttgttgcaaatatcgtaactctaccttgttcaagatccactaagactgattaaaaccgtttaaaatggctcttgttgacaagatttactatagaacatcttaatgactaaacaaaattatggtgtaattttacttgattaaagacaaaactaaaacctgtgcaatctccagtgtatgtgttaagatagcaacttaaaaacatctttaaagaatttagagcctggctcctgctggagagaaatgaaaatgggaatgtgggtattgttcatgggtttccttccccttacggcagcttcctgtgtggtttttgtttctttcatccctccgctggctctgtgtgcttttttccaattgtctagagagctagaaggtaatgactgtaaaaaaccaacgctacttgcaagcagggttgtatctctagatgttctctggacttcactccgtatctgacttcttatatgtgtttatcagtctcctgttcaaattccttctgtggctccagtcccaagcatcccctaatatcacaacacaacctgtttataagataaagctatgagtttattgcttactgcagtaaaaaaaaggacaccacctcatgcctcagtagggatggtaaggtcagatttttttttttttgggggggacggagtctcgctgtgttgcccaggctggagtgcagtggcacaatctcggctcactgcaagctccgcctcccgggttcacgccattctcctgcctcagtctccggagcagctgggactacagacgcccgccaccatgcctggctaattttttgtattttttagtagagacggggtttcactgtgttagccaggatggtctcgatctcctgaccttgtgatctgcctgccttggcctcccagagtgctgggattacaggcgtgagccaccgcgcccggccagggtgagaatttaatgagaatcggaagctcaacggaagacagggtcttccaaagtgggggcttgatgaaggatcaggtagagagcttgtcgtaacaacccaggattggtgcacacaccaagacgtagattttgaaaaaagggattaaagatgtttagagtatcaattattgatgtattccatggaggagctgatcttttgcagattcttaaaatgaacaccaattcctctacctggcagatgactgatggaaaaagaaagtcgtgctaatgaagacagaggaatagcacgaagtcatgttcatgtggacagaaaagtgctgttttttttttcttttttttgagacggagtctcactttgttgcccaggctggagggcagtggcgcgatcttggctcactgcaagctcttcctcctgggttcatgccattctcctgcctcagcttcccaagtagctgggactacaggtgcccgccaccacgcccagctaatttttttgtgtttttagtagagatggggtttcaccgtgttagccaggatggtctcgatctcctgaccttgtgatccgcctgcctgggcctcccaaagtgctgggattacaggcgtgagccaccgcgaccggcctaagaaggtgctgtttttgttctcagtgtccaggcagagagtgaggcattaatagatggtttccattcttactctccatggatgaagttgagggcgttggacgtattcccagggtcacatgtgatctgtcctctgcctttccatttccatcgcgtctccatctcagcttgtactctgtgatccagctctactgacttgcttttaacttcttgttgattcccaccccaggagcttagcatgggctgtagctatgcctggaatgccatttctccttcctattatttgcctagccaactctttttatatggcttaaacgtcacctcttcaggaaagtctcactgatttccaatctaaaggttggttcccccattctcaattcttttgagaggaaatgaactgaacccctttccacattgcttatgttttcttcagagaacttatcataatagtaactaaatggcaattttggaatcggttattttttatgcttgcctctgtctgctgctcactgctgtatgcctagggcttagaagagtgatttgcagctaatggatcctcaatagacatttgcagaatagatgattttgtgaatatggactgcgtctcctttgattgatgggaaaagcttttgttccattgaagttgagtgtgtatttctcatggaagccttctgtgatatctaaccccactgctatcggcaaaatagtgtctccccgaaattcatatattaaggtcctaatccccaatatctcagaatgtgactacatttggagttagtctttaatgaggcaagttaaaatggggtcattagcatgggccctaatccaatatgactgttgtccttataagaagagagacaccaggggtgcatgtgcatagaggaaagtccgtaggggacacagcaagaaaacagccatgtgcaagccaaggagagagaccccagaaacaaccaacctgcagacaccttgaccttggactttcagtctccagaactgagagaaagtaattttctctttaagccacacagtctgtgctattttaatggcaggtccagcaagctgatacccctgcctgagactgggttaggatcccctgctctgggcagcccttctgtttctccacatcaagatacttaatttctctgcattataattggctgtatccaactcgaagcttcagagcagaaggaactcacctcttccttcctggaacctggcacagggcctggcatataagaagtgtcttctgtttgtaaaatgaatgaatgaaagaatttgggaataaagtcaggatgctgagggttagcttttgtcaaatattgctgtgcagaaatttcattcatcaagtacttattccatgcatactatataccagacactaacctaggtgctaggaagaatgcagtatacaaaggagatttaaaaaatatccttgtcctcaagagtcttatatcgtgctagacgtagagaaataacaagcaagagaagtaaacatacataatggggccaggtctagggtgatacacatgaggcactgactgggtgcaaaatttaaggcagtgcaaaaaactggagtaattaggataaataatttaatgcaatttacaactttaatgcaatttttaatgcaatttttaaaacacaatgcaaaaatatccacaatggacaaaacatcaaaatcttcagtaaagacaagatggttatacagcctgctatgagaaaaaaaaagaattgggaatgggaacaggaaattttgtggagagaggtgttgaggttgtaggtggagtgaccagagaagtccctaccaagaagatgctacttgggtgaagacttgaaggaagagaggagcaatccatgcaaatatctgggaataactttctctgcagatggaacagcaggtgcaaaggcccctggggttgcaccacacttggagaggaactagtgtgactgaaggctaggagttagcaggggaaggggtacaggagatgaggttagaggggtaataggccaagatgcagagagaatgagctgaactcaatattgccaactcattcaaacttagaggctggaaatcaggattttaaagtggtatctcttaatttttaaaggaagtctactaatatgaaaaaataattaaacactgcataggctaaaatcagtagttcactactgcaggcaattttgcctcccacagaacatctggagatatgtgtggctgtcacaaccgggaagcagatgctactggcacctagtggatagaggccaaggatgctgctgaaatccagccttgcggccgggtgcagtggctcacacctgtaaatcccagcactttgggaggccaaggtgggtggatcacctgaggtcaagagtttgagagcagcccagtcaacatggagaaaccctgtctctactaaaaatacaaaaaaaaaaaaaaaaaaaaaaaaaaaaattagctggccatggtggcaggtgcctgtaactccagctactcgggaggctgaggcaggagaattgcttgaacccgggaggcagagcatgcagtgagccgagatcgcgccactgcactccagcctgggtgacagtgagactccgtctcaaaaaaataaaataaaaaataaaaaaataaaataaatcctgcctcgcacaggatagccccactccccccgccttgcaaagaagcatgatttggctggaaacatcaattgtgccttaggtagaaaactctgcgctaaatagaacatagctgtgaatggaaactgttgatgaggtcagcaattccaggaaaggatcagatgggccagaagctccactacggccctcttccctccacgcctcccaaaatgcccacccatttcctttatgctgcagcagaagtgattttccaccacatgcctaacactcctcctcattaagtaatcactatccacagccactcatttccatgtttgtagccagtccaggtgtaaaagacgcctgccctgttcataggagtcagatggagatcagccaattacagggctattagatgaaaatgcagtgccttccttatcttgcctctgtgggttgagctcttcacgatggtgggtttgcgcctgatcagtactttagtccaatgcccgcccagcctggttctctaattctggccagcagagcacaatttcctattctaaatggaacagctccgctgatatgttctgagcagcagcaatattcacccttttgcatactgtattcatagctgattatgcaaatcacatttcattagtcttttcctcattaaaatgatttgaaagacaaataattttggatagacttttattgttgtgcaagggtatgtctaaagcaactgtttttggtgcaatgagctagaacattagtcataaactaaaaaatccccacaaagccctgggaggtactgggaaaatgtgaaccgggtcatcaaaatagaaggtggtggtaactggggcagactggaggcagctcacctagactagaggagacatctagtcctcaggtccagccaatatggcagaatggcaactgggaccagtagggcaagactttttctttgacattttaataggactagaaatctgagattttttttttttttttttttttttgagatggagtctcgctctgtcgcccaggctggagtgcagtggcatgatgtcggctcactgcaacctccacctgctgggttgaagtgattctcctgcctcagcctcctgagtagctggaattacagccatgtgccaccacgcctgactaatttttgtatttttggtagagatgaggtttcgccatgttagccaggctggtcttgaactcctgacctcaagtgatccacccaccatagcctcccaaactgctgggattataggcgtaagccaccacccctggtcaaactctggatttttaaagaactctatctgctttaatacactgaatgggaattctttgacatttatgtagtgtagatgtagtgtgtgggttatcagatggtgatctctagttaggttctgggaactatctgggttttgcatgtgagagtaactcagtccagaaagttaaaaatggactgggtgaagaaggaagggatggtggattcaaggtctgcccaactcaggaatagtggttttcctgcccctaaaccaaagcctcgtcatcctcatcagtatcataatggccatttgtgtgcacagcatcgtaagggaagggccttatcgttaactcatgcgtttcttaaaacaccctgtgacccattttgcagatgagagagctgactcttcataatcacatgacaaatgagtgcatacccagaatttgagcctgtgactctacattctgagctttgatctattactatttgatctattactgctgactatagatataggttggaatgaatgtagtaaagttttaggatacaaaaatcagtagcaattctacgcaccaacaaccgttgagctaagaaccaaatcaagaagacaatccccattacaatagctataaaaacatataaaatacctagcactatatttaaccaaggaggtgaaagatctctgcaagaaaaactctaaaagaccgatgaaagaaatcctaggtgacacaaacaaatggaagaacattccatactcatggatcagaagaattaataccattaaatgaccatagtgcccaaagcaatctctagattgatgtaatccctatcaaaataccagtgtcatttttcagataaaacaaacttaaaatatgtttaggctgggcgtagcagctcatggctgtaatcccagcagtttgggaggctgaggtgggtggatcacttgaggtcacaagtttgagaccagcctaaccaacatggtgaaaccctatctctactaaaaatacaaaactcagccaggagtagtggtgcatgcctgtaatcccagctactcaggaggctgaggcaaaagaattgtttgaacctgggaggtggaggctgtagtgagccgcgatcatgccactgcactccagcctgggcgatggaatgagactccatctcaaaaaaaaaaaaaaaaaaaaaaagtttttaaaaaaaggcccggaaattgtggctcatgcctgtaatcccagtgctttgggaggctcagatgggaggattccttgaagccaggggtttgagaccagcctgggcaacaaaatgaggccccatctttagatagagtttttaaaaagacagatatagtttggcagattattttcttaacaatgtaaagactctagagaaagctgaggttgagtgtttctgaacttgagaaaagtgttttgtagtttttggccatatccctatatgtggagtgggacaaagtcaattagccatccgagagttctctagactcatgaaaggcaagaagacagcaaagacaaagttggccgtcctcaatggctcttaacctatgacctatgggagttggtgtatcaatacccagctccctcactgcccttaagtgcctgttctataccattcaccagagctttgcagccctcgttgcccacaggagtagcttgattgataacactgtacattgacttctttcccttttttatctcactactttcacctctcacatcaactacaaatgcttgtcttagggtcttctcctgagagaacccaaactaagacacaaggaaacctcaaattctttgttttttgtttaacttgcattgtgtttgcatctttttgaactaggctagtcatgtcatcaagtttatccatctgcattcaattaaatttttagacagaggtcccttgctgttgcccagactggatagcagtggtatgatccaatcacagctcactgcaacctcaaacgcctgggcttgagtcagccttctgcctcagcctcccaagtagctggaactacaggtgcatgccagcacaaccaactagttcaaattttttttgtagagatagggtctcactctgttgcccagtctggcctcaaactcccagccttaagtgatccccctgccttggcatctgaaagtgctcagattacaggcatgaaccatgcccaatcccatctgcatttattatgcaatgtctagggtaatattgggcagattacaacagaatttagaactagttttaacttaagcttactagtagaagaattctaaaataaaaggggaggcaagatataaatcaaaaggatttggtcaaagagaagatacttgtattgctgtagttcctgccacgtttccattggttgaaatacagttgattgtctacagtgcagccttaccagtgataaggggctgtcttctttaatcttcctttttaatttgcttcctaattactttaaaggaagaactctttggcactgaaaattactctagattgtaaccaaaaaaagatccagaacctttttttttttttttctatttcttttaatcttcattcaggggcatagtataattgaattaagacgctaccagtgggtgaattacaggataataattcagacctttctgtttaataggggctggcctgtggccttgagtccactagatctgaagggtgaattactgctccataactcactagctcccatttaaagagaccctggttaaagagaattaacatcaacaaccaagtcaggaaaaggcaacccaagacctaagagtaagagatgaggataacacagaaatgaatttggaaagttctggcttctcacttcaaagaaggcaggcttcagagaataaaaaaccttccataaaaaaccaaaggcctctctgctcagcagagctctgggtgttttttcaccaaagccctggcaaacatacccagatgtctcaagcatgcatcctttcagatctaataaaatgactaactgggctttaaacctagcctggatatgggcgaggtgtccggcagttacctgcaccttgaacagagtggacaataacacccaaagtccttctttctgtcttccctaaagtgtatgtatgttatttatttattgtttatttatttagtctcactctgtcatccaggctggagtgcagtggtgtgatctcggctcactgcagcctctgcctcctgggttcaagtgatttttctgcctcagcctcccaagtagctgagattatacacatgtgtcaccatgcctggctaatatttgtgtttttagtaaaaatggggtttcaccatgttgtccaggctggtctcaaactcctggcctcaagtgatttgcccacctcagcctcgcaaagtgctgagattacaggtgtgagccaccatgcccggcccctgatgtgatgtttttctagctgatgcctgaaatgtcaccattagcaatttttttttttaaagtaaaagctgacatccttctgtttcctcttttccaaaaaagagttgacagtggacataagttaaatattatagcacttaagtcatagatatgaattcagatctaaacttcattgactgtgaaatcaaagggaaattgcctaccctctctggtttcaagtttctcatctataaagcagggattgtaatagtcccaacttcttagggctgtcataaaagttagataaaagaatggatatgaaacatagaaaaatggctgacgtggagtaagacttcaataaagaataagcattattccactgcactccagcctgggcgacagagtgagactccatctcaaaaagaaaataagcattattatcgaaaaatatcctttagagactgaaggatgtgaagaattgcattgctgattttagtttctagaataagaatgtcatccagtgtaagagaaaaagggtgatcaattcaatgtggttcatagatatcattctctaagatggcatgaattgatagttcaccgtctttggggtaaacccaacttttgtgaatttctaaaatccaagagacaaccacctcagctgcaaaggatctcatccagcttaggaggtcagtagcagctgataggacaggttccattttcacttcctcttagacatcttgcctgtctctgccaaccttctgctatctgtcccagacttttacttaaagataaaaagagaatgcttataattcattacagttcattaaaatgaaaataaaatttattttgcatcaaaatgaaaaaaagactcatttattattagcatataaatggcatttttaaatgtcactctgcctcaaaatcacttacattttcagtgatcatagcacacaaaattaatttttgatagccttttgtgatttggctggaaattcttatttctttttgtgctttaaacagcaaactgtatccactgctattcatagcaaattttagataatgaagcaattaaaaatacatggatttaagatcttatctcatttttcctttggcctatttctgcttcattattcatgaagggatatgtttaattcagagttagtaattgcagatatatctagtataaattgtgcctcatattctttacccatttcaatttattttagcaaatagatctctgtttgaaaaaaaagtcattgagagagggtgagtatgacaaaaatgcagaaatctgcgtgtatgtgtatattgattgacatatccaaaccagatctcaaaaatgttaataaccacatttcctgaggttttaccaagagccaggcactgtgctgaacaattttacacagcatttcactcaatcctaagagtaactttaggagggctgtatagttagtgctcccattttttagatacggagactgaggctcaggtcaaaaaagtggcctgaagtcacatcattagaaatgacaaagaaccagaattggaacttggcttgtctgtctccacagcctctgtattagaccattcatctcctgtgttctagaacaaagtgtattaaagcctcaaagagatttgtcaaaggctgctaaaatcgtcctgcagttccacctaacagcatccaaagttcataaagttgctggtctgaggagctgtgacttatttggtttccatgagctctaaatatattttaggaatttatcctagagaaataacaggtacacatggtttctttttttttctttcttttttttaagttctagggtacacgtgcacaacatgcaagtttgtttcataggtatacatgtgccatgttggtttggggcaaccatcacctcgtcatttacattaggtatttctcctaatgctatccctcccccagttccccacaccccaataggccccagtgtgtgatgttcccctcactgtgtccatgtgttctcattgttcaactcccacttatgagtgagaacatgtggtgtttggttttctgtccttgtgatattttgctgagaatgatggtttccagcttcatccatgtccctactaaggacatgaactcatccttttttatggctgcatggtatttcatggtgtatatgtgccacattttctttttttattttttttttattattttgttttattattatacttcaagttttagggtacatgtgcacaacgtgcaggtttgttacatatgtatacatgtgccatgttggtgtgctgcacccattaacgcgtcattagcattaggtatatctcctaatgctatccctcccccctcccccaccccacaacagtccccagtgtgtgatgttccccttcctgtgtccatgcgttctcattgttcaattcccacttaggagtgagaacatgcaatgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcattgatagatgtttgggttggttccaagtctttgctattgtgaacagtgccacaataaacatatgtgtgcatgtgtctttatagtagaatgatttataatcctttgggtatatacccagtaatgggattgctgggtcaaatggttatttctagttttagatcattgaggcatcaccacactgtcttccacaatggttgaactaatttacactcccaccaacagtgtaaaagcgttcctatttctccacatcctctccagaatctgttgtttcctgactttttaatgatcaccattctaaatggcatgagatgctatctcattgtggttttgatttgcatttctctgatgaccagtgatgatgagaattttttcatatgtctgttggctgcataaatgtcatcttttgagaagggcctgttcatatcctttgcccattttttgatggggttgtttttttcttgtaaatttgtttaaattcttcgtagattctggatattagccctttgtcagatggatagattgcaaaaattgtctcccattctgtaggttgcctgttcactctgatgatagtgtcttttgctgtgcagaagctctttagttaaattagatcccatttgtctattttggcttttgttgccattgcttttggtgttttagtcatgaagtctttgcccatgcctatgtcctggatggtatcgcctaggttttcttctaggatttttatggttttcggtcttccatttaagtctttaatccatcttgaattaatttttgcgtaaggtataaggaagggatccagtttcagctttctacatacggctaaccagttttcccagcaccatttattaaataggtaatcctttccccatttcttgtttttgtcagatttgtcaaagatcagatggttgtaggtgtgtggtgttatttgaggcctctgttctattccatatgtctatatatctgttttggtaccagtaccatgctgttttgtttactgtagccttgtagtatagtttgaagtcaggtagcatgatgcctccagctttgttctttttgcttaggattgtcttggctatgtgggctcttttttggttccatatgaaatttaaagcagtttttttccaattctgtgaagaaagtcagtggtagcttgaggggaatagcattgaatctataaattaccttaggcagtatggccattttcatgatattggttctacctatccatgagcatggaatgttttccatttgtttgtgtcctctcttatttccttgagcagtggtttgtagttcttcttgaagaggtccttcacatcccttgtaagttggattcctaggtattttattctctttatagcaattgtgaatggcagttcactcatgatttggctctctgtctgttattggtgtataggaatgcttgtgatttttgcacattgattttgtatcttgagactttgctgaagtcgcttatcagcttaaggagattttgggctgagacaatgggttttctaagtatataatcatgtcatctgcaaacagagacaatttgacttcctcttttcctaactgaatatcctttatttctttctcttgcctgattgccctggccagaacttccaatgctatgttgaataggagtgtcaagagagggcatccttgtcttgtgccagttttcaaagggaatgcttccagttttttcccattcattatgatactggctgtgggtttgtcataaatagttcttattattttgagatacattccatcaatacctagtttattgagagtttttagcatgaaaggctgttgaattttgttgaaggccttttctgctctattgagataatcatgtggcttttgtctttcattctgtttatgtgatggattacgtttatcgatttgtgtatattgaacaagccttgcatcccagggatgaagctgagttgatcatggtggataagctttttgatgtgctgctggattcagtttgccagtattttattgaggattttcgcatcgatattcatcagggatattggcctaaaatcctctttttttgttttgtctctgccaggctttggtatcacgatgatgctggcctcataaaatgagttagggaggattccctctttttccattgattggaatagtttcagacagaatgataccagctcttctttgtacctctggtagaatttggctgtgaatccatctggtcctggactttttttgggtggtaggctattaattattgcctccatttcagaacctgttattggtctattcagagatacaacttcttcctggtttagtcttgggagggtgtgtgtgtccaggaatttatccatttcctctagattttctagtttaataacatagaggtgtttatagaattctctgatggtagtttgtatttctgtgggatcggtggtgatacctcatttatcattttttattgcatctatttgattcttctctcttttcttctttattagtcttgctagtggtctgttttgttgaacttttcaaaaaaccatctcctggattcattgatttttttgaagagttttttatgtttctgtctccttcagttctgctctcatcttagttatttcttgtcttctgctagcttttgaatttgtttggtcttgcttctctagttcttttaattgtgatgttagcatgtcaattttagatctttcctgctttcttttatgggcatttagtgctatgaatgtccctctacacactgctttaaatgtgtcccagaggttctggtagtttgtgtctttgttctcattggtttcaaagaacatctttatttctgccttcattttgttatatacccagtagtcattaaggatcaggttgttcagtttccatgtagttgtgcagttttgagtgaatttcttaatcctgagttctaatgtgattgcactgtggtctgagagacagtttgttgtgatttttagtgttttacatttgctgaggagtgttttaattccaattatgtggtcaattttagaataagtgtgttgtggtgctgagaagaatgtatattctattgatttggggtggagagttctgtggatgtctattatgtccacttggtctggagctgaattcaagtcctggatatccttgttaattttctgtcttgttgatctgtctaatattgacagtggggtgtttaagtctcctgttattagtgtgtgggagtctaagtctctttgtaggtctctaagaacttactttatgaatctgggtgttcctgtattgagtgcgtatatatttaggatagttagctcttcttgctgaattgatccctttaccattatgtaatggccttctttatctcttttgatctttgttggtttaaagtctgttttatcagagaccaggattgcaacccctgcttctttttttgctttccatttgcttggtagatcttcctccatccctttattttgagcctaggtttgtcttttcacgtgaaatggatctcctgaatacagcacactgataggtcttgactctttatccaatttgccagtctgtgttttttcattggggtatttagctcgtttacatataaggttaatattgttatgtatgaatttgatcctgtcattatgatgctagctggttattttgcccgttaatttatgcagattcttcatagtgtcaattgtctttacaatttggcatgttttcacagtggctcatactggttgttcttttccatatttagtccttccctcaggagctcttgtgagtcaggcctgctggtgacaaaatctctcagcatttgcttgtctgtacaggattttatttctcctccacttataaagcttagtttggctggatatgaaattctgggttgaaaattctttaagaatgttgaatattggcccccactctcttctggcttgtagggtttctgcagagagatctgctgttagtctgatgggcttccctttgcgggtaacccaacctttctctctggctgaacttaacactttttccttcttttcaaccttggcgaatctgacaattatgtgtcttggggttgctcttcttgaggagtattttgtggtgttctttgtatttcctgaatttcattgttggcctgccttgctaggttggggaagttctcctggataatatcctaaagaatgttttccaacttgattccattctccctgtcactttcaggtacgccagtcaaacgtagatttggtcttttcacatagccccgtatttcttagaggctttgttcatttcttttcattcttttttctctaatcttgtcttcttactttatttcattaatttgatcttcaatcacttgtatcctgtcttctacttgatggaatcagctactgaagctcgtgtatgctccccgaagttctcgtgctgtggttttcagctccatcaggtcatttaagctcttctctatactggttattctagttagccatacgtctaaccttttttcaaggtttttagcttccttgcgatgggttagaacatgctcctttatctcggagaagtttgttattattgaccttctgaagcctacttctgtcaactcgtcaaactcattctccatccagttttgatcccttgctggcaagaagtagtgttctttggaggagaagaggtgttctggcttttggaattttcagcctttctgctctggtttctccccatctttgtggttttatctacctttggtttttgatgttggtgacctatggatggggttttggtgtggatgtccttttgttgatgttgatgctattcctttctgtttgttagttttccttctaacagtcaggcccctcagctacaggtctgttggagtttgcttgaggtccactccagaccgtgtttgcctaggtatcaccagcggaggctgcagaacagcaaatctttttgcctgatccttcctctggaagcttcatcccagaggggcacctgcctgtatgaggtgtctgtcagcccctactgggaggtgtctcccagacaggctacacgggggtcagggacccacttgaggaggcaatctgtccgttattggagcttgaacaccatgctgtgagaaccactgctctcttcagaactgtcaagcagggactttttccatgtggtatcttttaatacaagttgtcacagggttttatacaccagtaaaaaagcaggaaagaggaaagaaaaaaggaaatggctcaacaatgttcaattatatgttaaataaatcctgatgcatttatttagtattatactgtaacaccatcaaaaatgagttgtgaggccaaggcaggtggatagcttgagtccaggagttcaagaccagcctgggaaacatagtgagaccccatctctacaagaataaacaaaactagctggacattgttgcacgtgcctgtagtgccagctacttgggaggctgaggagggaggattatttgagcctgggaggtcgaggctgcaatgagctaggatggcaccactgcactccagcctcggcgatagagtgagatccagtctcaaaaagagaatcttagtttactgacatgtaaaaaatgtgtctgcaggttataaaagtggcaggtccataaaacaatatatgtaatgtatcccttttctaaaaaaaaaaaactacatatgtgtatatatatgtgtaaatgaggaaagagagaagccaggacatctcagcttttctgagattttgcacaacaaaaacataacacaagccacatatgtaatttaaaattttcttttttatttattattattatttcttttttattttattattttttctcccccacttgtaaatagcattattgctttactgatgatcagctttgttttataaaaaactcagaaaattcagtaaagtatgcacaagaaaggaaaaatgtcataactacaccagccaaagatcagtcccctgtatctaacagtgtgtgtgaatcttgctagacctgccctgtgctatttggtggtcatgagccacgtgactcctgagcactggaagtgtggctggtccaaactgagacgtgctgtaagtgtcaaagacatgctggattccagagatttagaaccaaagaagatagtacaatatctcattaataatttttctattggttacaggttgaaatgctaatatttgaagtatttaaaaataaaatatgctactaaaattaattttacctgttttttcactttttattatagctattagaaaattttaaatttctcatgcctgtaatcccagcacttggggaggccgaggcaggcagatcacctgaggtcaggagtttgagaccagcctgatgaacatggggaaacgccacctctaataaaaatacaaaaattaaccgggcatggtggtgcgtgcctgtaatcccagctactcaggaggctgaggaagcattgtttgaacccaggaggcagaggttgcaatgagccaagattgcgccactgcactgcaccctgggcgaaagagtgaaactccgtctcaaaaaaaattaatattttgatacagccatgcaatgtgaaataatcaaatcatggagaatggagtatccatcccctgaagcatttgtcctttgtgttagaaacaatccaattaagctcctttagttatttaaaaatgtacaattaagttattgactatagtcaccctgtgtggtatcaaatagtaggtcttatttattcttttttttttttggagacagtctcgctctgtcacccaggctggggtgtagtggcatgatctgggctcactgtagcctctgcctcctgagttcaagcgattcttgtgcttcagcctcccaagtagctgggatttcaggcatgcaccaccacgtttggctaattttttatatttttagtagagatggggtttcgccatgttgtccaggctggtctcaaactcctgagctcaggcaatctgcccgccgtggcctcctgaaatgctaggattataggcacgaaccaccatgcctggccttatttatttctaggtatttctttgttctcattaacattctccctgtcaccccactattctttccagcctctgttaaccatccttctactctctatctccataagttcattgtttttatttttagatcccacaaataaatgagaacatgcagtttgtctttctgtgcctggcttatttcacttaacataatgacctccagttccatctatgttgttgcaaatgacaggacctcattctttttcatggctgaatagtactccaaatggaaagtctctttagtgatcttctgactcagtcaataaaatgcatcaatattccactgggtatgcatgcctctattctagattctggaggtactggagaaaacaaaacaggcaaaactgccaccctcatggagcatgagttctggtaggagagacagaaaaaaaatgcaagaaaatacgcaatatttcacgtgttgatgagagctatggagacaaaggagaagggagaagaccaaggtgttctaatgaaggatgatcaggaaggctcgtgttataaggtgacattgtgcagagacgtgggggaaatgagtgaatgtgtcttgaggctgagagacagccgtctggcaagtccacaggcccctaagcagaaacaagcttggcgtgatggaggaatcacaaggggctgtaatggctggagcagagcttatcctcccagttgaggaggtaggaagtagaggttgagattttggagtcgagcagacctgagatatctaatatacaattttaaggcactggtgttgctgtgatagaacctttctgggtcaccccaaagtactgacaatgacaaatatattgggcaggcggtgtggggaatgtcagagaaagaggctgagtttttctctgggtccatgcagtgcagagagaagagaataaatgtgagacagagagaaacgggagcaggaacttggaggtagaaataatcaaaagaaacaggaaccctgaggaatctgcaaaagtcttggcaagatgttcaactcataggatgtgggatataagctcaggccaaatttatttaaaatgcaaaggaagaggtgaccacagcttacctctgggccaagcttatttagtataccaaatatttgaagaatcatttcttcttaatttggtttgttcttagtagatgctcccactggtttaaacctgaatttcaagctgttgtgttttttttaaacctacactaaataatacacgggtgggtgaaaagcagaaggaggctttgtgaatgagcttttttaaatagtgagattccttggcatgcataaaatgttatttgggatagaagaaagcttgatttatgaaaatcttccctaggccacgtagtgcagaatcaggggactctggcatcgccgcccggcatgcaaataaacgtttccagcagttctttagagtatgcatttcttgtttttttggctgcagaaagtatggtgtccaaaaattaggtagggtttgctttgcattccagttgtccgtgttgccagaaaacaatgccatctggatgtcattccttcacctagagtaaggcgctgtcaccatgcgtaagcattataacataatctctgggttacagtcctggctggtcactgactagcttggaaagtttaccacaaatcctctgagtctcacttctccctactgtaaaggcaggataattattaatttgagaacacgtttggttgtactgaggatccaataagagaatatttggcagaaaaatctggccaatggtaaatggtattcagtaaataaacacattttggtcgtcagcagagagctacctggattttattttatttccttccttttttttttatcgtagagaaaaatgacagggattcactttctaagaaattacactatgttcaatgacttcccatcaagagtaggcaatgttccgtatcctgccattggtaagtatcaaatgggcccgtgtcagacaagtcatggcttttaatctccctttattggccacgtcacctgtcagtgaccttgactgttgccggctgcctcatgttctgcagtttcctgataagtgtgtttccggcttttgaagttatgtctgccgaaaaccacatctggttcaccgccgcctcaacagacacacaatgaaatacaaaaggctaattctgctgtgtacgcaatccatgtttctttccccagaggattccagatggagtgaactcagtagaggcggtgcttcgacggctgatgatcttgcggagaggagagaggagcattagttacggttttaagtcccggctgaactggcaggggttacatgacctcagactcaggggtaagtgcgcaagctctcgcccctggaagggctgtgatgcctttcaacagccacacctctccgttgaacccatcaacaccctttgtgcagaggtgggttgagatttctcagatgaagtaacatttcctactctagtagtctcaattggtaaatataattgtttttttttttttttttttgagacggagtcttgctctgtcgcccaggctggagtgcagtggcgcgatctcggctcactgcaagctccgcctcccgggttcacgccattctcctgcctcagcctcccgagtagctgggactacaggcgcccgcaaccacgccaggctaatttttttggtattttttagtagagacggggtttcaccgtgttagccaggatggtctcaatctcctgacctcgtgatccgcccgcctcggcctcccaaagtgctgggattacaggcgtgagccaccgcgtccggccggtaaatataactttaatgtggacatcagaaggaattctggtattacgagtggtgggagaagcattttatactttattagggtatgaataacaacatctttatttacttttaacttttattttaggtttaggggtacatgtgcaggtttgttataaaggttaaattgcatgtcattggggtttggtgtccagattatttcatcactcttgtaatgagcacagtacccaataagtagttttttgatgctcaccctcctccttccctccctgctcaagtaggccctggtgcctgctgttcccttctttgtgtccatatatactcaatgtttagctcccacttataagtgagaacatgcgacattagattttctgttcctgagttagttcacttaggataatagcctccggcttcctccatgttgctgcaaaggacataatctaattcttttttatggctgtgtagtattccaggctgtataattaccacattttctttatccagtctaccgttgatgggcatttaggtggattccatgtctttgctattgtgaatagtgccgtgatggacatacatgtgcatgtgtctttatggcagaacaatgtatattcctttgggtatatgcccagtaatgtgatcgacaacatatttatttaaaaattgagcacttatttaaaaaatcttaagtgctttcttcattggctgtgaaagctctgagttttctgtgaatgtcattaggtccattgtacacatgtgaaaagtaaagcaacacacccaaagatggtcagtcctttgaacttgggttgtttgatgtttgtgactattacatagatgccatttatattgagtatatgtctagcagctttattgctgggtcacaggctggacgtatgtttagttgctggagattgccaactcattttccaaagctgttatacccatttgtatcaattttttccaagcagcacagccaaatttgaagctggatctggctgattccagctctaacttttttttttttttttttttttttggagagagggtctcactctgccacccaggtgggagtacagtggcacaatcacaactcactgcagctttgatctccctgggctcaagtgatcctcctaccccagcctcccaagaagctggtactgtaggcatactccaccatgcccagctaatacttgtattttttatagagaagggatttcatcatgctgcacaggctggtctcgaactcctaggctcaagcaacatgccgaagtgctgggactacaggtgtgagccaccacgcctggcccctaatatatatgtgtgtgtattttatatacgtatatataatgtattacacatatttttacattatatatattttacatatatattttatgtattatatattttacatatatattagaaacatttacacatatatatttacatgtatattttacatgtatatgtttatatattttttatgtatttattttacatatattttaagatatataaaattcatagcaggcaaaaacagcttctaatattttgaaccattgtactatatcctacgaaagtactaagtataaataagagagacttcccggagaaccattgctcctggccagtagagggtttggtttttggaggtggttttgttttgtaaacgtctttgttaatatggaacattcagacaagtgcataaatcttaagtgagcagctcagtgaatttttgcaaagtgattattaccatgcagctaccacctgaccaggatataaagcatttctagcaccactgacagccttcctccaactttgttcttattccaaattatctttactctagtgacccttcacaattccacatgccatttagcatgatgcggtcattttccacaacaaaaaaatcctgctgggattttgattgagattgcattgaattgattgattaatctgaagattttgttagattggttctttcttccctaagtattcaaaataattcactggtaaaaacacgtaggcctggggtggttgtgtgtgtgtgtgtggtgtggagggactgagagaagggatgaattataattacagatttaatttctttttttaatttgtaatttttgtgggtcaatagtatgcatatgtattttggggtatacgagatattttgatacaggcatatgatgtgtgataatcatgtcagggtaaagggagtgtccatcacctcaagtatttatcctgtctttgtgttacaaacaatccagttatactcttttagttattttaaaatgtacaatgaattattgactgtagtcatcccgatgtgctatcaaatacagatcttattctgttgaactctgtacccattaactatccccccagccactagcctctgataaccacggtccaactctctatctccacaagttcaattgtttttctttttagctcccacaaatgagtgagaacatgggaagcttgtctttctgtgcctggcttatttcaatgaacagaatgacctccagtttcatccgtgttgttgcaaatgacaggatctcattctcttttatggaggaatagtactccattgtgtatgtgtaccaaattttctttatccattcctctgttggcgggcacttagattcttctagatcgtggctactgtgacaagtgctgcagtaaacacgggagtgcaggtatttctttgatacactgatttcctttctcttgggtatatatctaacagtgagattcctagatcatagggtagttcaatttttagtttttttgaggaacaccctagatttaatttattagctattggagtattcggattttctgtttcttatgtcagttttgctaggtcatttttagggaaaaacttccattttatctaaatcttccaatctattgacttaaagctgttctacaacgcatcaaggaattattttatgtgatagatacgttctatgtgttgattgtggtcatatttacatgggggtatacatttgtcaagtcttattcaactgtgcacttaaaatgggtacattatatgtatttacattatatgtaaattatagctcagtgtggttcaataaaaatttacaattgataccattttatttttacctgtacttatgaaaaaagttaaaaagtttaatcatatcaagtgttggcagtaagataggctacactgcaagagagggtatacattgccacaaccacctggaagaacaatttggaaatactatttatttatagattgattgatggagtctcactctgtcacccaggctggagtgtagtggtgcagtctaggctcactgcaacctctgcctcctttgttcaagtgattctcctgcttcagtctcccaagtagctggaattacaggcatgctccaccatacccagctaatttttctatctttagtagagatggggtttcaccatgttggccagaatggtctcgaactcctgacctcaagtgatccaccccccactggcctcccaaagtgttgggattacaggcgtgagccaccacacccagcctggaaattcttttaaaatgggaaatgattatatgctatcacctacagggacacattttagggagatcctcacacatgtgctcaaagagatgatgcaacatttattgcagttctgtttgtaagagaaaaaaaaattaaaaatgtaaccatcactcagaggtgaatggtggtaaacatacatggtaaaatagctcttaaatatagcaaattaaaattacatgtttgcaacttggacaaatccctcaaaggagtgagaaaaaaattacaaaggaactacagttgatgccatttatatataaatttttaaaagcactattcttcccccggtgtcataaaaattttagctgagtatgtggaaatccagaataaagatttccttgcagctaggtgtgcccatgtttaagctatgttcaacaggatgtgaggtgtgttcagcaattctggaaaccttccctaagtgacagctgaggaaaaccttttaactctgtcacttccttctcctacctgtctttcccccttttttctttctgtgtttgtttcccagggctactgtaagcagacaggaggagtctccagggattgtaggaatttaatccatttgagcaatcaggctgttttacagcttcctgccctgcagcctgttcttccccagccctgggtagaaagaggtcatcttgtcagtttaaaccagctcctgacaagtgatgaacccaagtgaacgttccttattaccatgctcaagtctctaccctgggaaaagctatagcttccttaccataacatgcaaactatgtgctggcatgatgacttactgtgtctgtacatctacgtgggatgacgtgtaccctctctcctctctatcaccccataaaaccctcgtcactttccctctgagagacactgctttggagaatcctcccagtgtcgtccttacttgagccaagtaataaaactcccattgatcaaaacctgcttccttgtggagagtcatttgttacttgtcaggggaatgaaccccggtgtttttcgggtaacgctactgtagcaaagagctgtaaactaggtggctttaaacaacagaaatttattctctgacagctctggaggctttagaagtctgaagtcagtgctctctgggggctctagagaagaatggattatgtgccttgctcccacctccttgtgttgctggtgatctttggccctccctggctacagatacatccactatctgcccctgtcttcagattgcatcctctcacatgtgtccgattctgggtctctcctcttcttataaggacacccgtcacactggatcaggacccaccctaaaccagtatcttaacttgatcacacctgcaaagaccttattttcaagtaaggccacatttgaaaatcagggggggtggggttaggactttaacatattttttgtgggaacacagttcaacccacaccatcttcctatcctcctcctatttctttaatccttctaaacctttctgtgggttgggatgtgaatgtgatagcaggagctataacagctgtattggaccatgaggtaaattcagaaatagactccaggaatggaggacctaaaaaatcaaagacagttgggttcctaacataataatgaggccacatcaggtatagactacctatgaagactctcatatgcaaaataaataaatatttatcttttaaacctctcttctctttgtgttggggttttttcacttgcagtcaaatctaatcttaatacacacacacacatgcacacacacacacacacacatttgctcatatgatttgttggactctaagtgtgaacatactaaacttatgaagcgtggctatctctgaggaagagagagtagaatgagaaatgatggtcagagggaacttcaacttcctctgacaccttttatttctttaagtaaaagaagacaaatatactaaaagtttagtattaatagctttgaattatagatggtggaaatctttgataacattaatatttgaattttgaattttaaaaatttgtccttccagaatctcctcaaatattaagaggactctatttgcaccttttactccaagtcgcatgaatcagtgtgaaattcctggaatgtactggctattttttttcttttttttgagagagtctcactctgtcacccagggtggagtgcagtggcgtgatctcagttcactgcaacctccacctcctgcctcaagtggttctcctgcctcagcctcctgaataactgcaattacaggtgtgcaccaccatgtccacctaatttttatatttttagtagagatggggtttcactatgttggccaggctggtcttgaatttctgacctcaggtgatctgcctacttcagcctcccaaagtgctgggattacaggcatgagccaccatgcttggcccctgcactggctatttttgaccctctctggacatactacctgccccagttggactgtcctccttttcctcacctgggcatctcctaagcatcctccagtctcagctccaagttaatgacaggtgatgagacatctaagtaaacatttggaaaatcagcgaaaattaatttccatcagattccataataaaagcccaatagatggttctttttcataattgcctaaattacaaaagtaacacttgctcaccataagaaatgcaaagaccaggataataaaacttgataagagcaaaaattgaaatctgccttttatcatctccattgtatcccaggcacaactaatctgtataaaggtttaaatatcttaaaactaaactgtagagcactaggataaaattggggactattttaaaaatccaatggtaggaatgaatatttcttacatggaactgaaggtggaaactttaaccagattcttctgtaattaaaacagttttaaaaatcttacataaatgaaaaactaggaaaatatctgcaacatatacaatggaccagaattacaatatccttaatatgtaaagggatatttcaaattcatacagaaagaaaaaacaggtattttattttattttattttattttatttgcgactgagtcgtgctctgttgtccaggctggagtgcagtggcgtgatctccactcactgcaacctctgcctcctgggttcaagcaattctcgtgcctcagtctcccaagtagctgggattataggcacctgccagcacgccaggttaatttttgtattttttctagaaacaggtttcaccatgttgaccaggctggtctcaaactcctgacctcaagtgatctacccaccttggcctcccaaagtgctgggattacaggtgtgagccactgtgcccagccacaacaggcaattttggagagcaaaaactaagtgtaactggtacataaaaataaataatatctgttgatggggagaatgtaggggaatttgcacattcatataattctggtggaattgaaaaatcaacaaaactttctaggagaaaatgtggccctatgtatcaaaagcctttaaaaagatacagtatccccctttattaatggtttggatgtctggggtttaagttacatatagacagtccaataaaatattttgagagagagagagagatcacattcacataacttttattgctgtatattgtcataatgttttattttttgctaatcttttattgtgcctaatttataaaataaattttatcataggtgtgtatagataggaaaaaaacatagtatgtatagggcttggtaccatccttacttccagccatcccatgggggtattggaaagtatacactccaccaccgccctgtggaaaagggagtctactatgcatgattttgactcagtgatttcactaggaatcccttaagagaaaataaagaggactatgggtgagctaccaatctattcgtctcaatggtgcatatagtagcaaagaaaattgtaaacaacctgtttataatcttcattaaacaaatgatggcatatttgttcaatagaatagtatgaaggttattaaagtgacttaatttcttcagaagatgtttgcaatgtattaagtgaaaaattaaaaattatataaatccatctttttaaaaaggtgtccgtacatgtatatcatacagaacactggaagaattatatatcaatgtgtgcaaggggggatgtttcagaggggtgggactatgggtaattttcatttcctttttgtttgttttgttttgttttgttttttgaggcagagtttcgctcttgttgcccagcgccatggcacgatggctcactgcaacttccgtctcccgagttcaagcgattctcctgcctcagcctcccaagtagctgggattacaggcatgtaccaccacacctggctaatttttgtatttctagtagagacggggttttaccatgttggccaggctggtctcgaactcctgacctcaagtaatccatctgtctttgccttccaaagtgctgggattacaggcatgagccactgtacccagcctcatgttctttttatttatcaatatgtttacaatgaggaaaatgtttaaaaaggtcccagttgaagcatctcatcctttgggaagccttcctgccctccagtccttataaatacccttcctgtgtgtgttcactgtgtgtatctcacaagactagcaagctgacctcttcagtgttaatttccttgttctgttcattgttcatcactagagtataacttccttgaggaaaagagacatgtcttgccttgtcactgcattctcaatttgtagtttgaagaatgtttgttgaatgatgaattgaaaatgtccttttatttggtcttttaagtaactatctgctagcatcccactgtttaataatttataaaattggaaatcacaaatttctaatgggagtgagtaattgcttcaaactctggttttgccaatggagaaacagaggctggggagaaacgaagtgacaaccggtgttgtgtggtgggctaggggcaggctaggaccacacctgctctcacggtttttctcctgaggctttcacagaccagactgcttagcaggcctcctgatttgcttttgttatatggggaaatctgacacacagagaatcgtgagggggatgaatgtttctagttagggcaggagggggcagtgagaaagggagaaatctggctgcccatgagaaacaaggtttaaaactagattttatgatattccacctgtctccatgctctgaaattgtgtgcgtgtgtgcgcgcgcacatgtttacttcatggggaagaaagtgcaagaaaactttatctcgggcagcctggcaaattcaacctctaagacagccaccctcagaaatctgctcaagctgttcctttctttcctcaaatgtcccctgatggtctccccacctctcaaatttgctgggtcattgcatctgtttctacctggctgcatctgagtagtcgcagtgtcagtaagtgaatttgggcttccagctgcgggcctcagcaagtttatctctgaaaatggacctgtcttcacacttaatcgtgtctctgtgtcccccatctctgagcaaacagctggaaagtgagttgagtcaaccagtagttggtctgcatggggctttctggatgacacatattttgatatttaatcctcaaaacgttttgatatttaatcctcaaaaccattctgtgaggaagagctgtcatccccattttgtagatgagaatactgagtcccagggagagaaggttaccttccctgggttatacagccgcaagtgggtgaggctggctgagaaagctgagggtttgggtatgaggaagttaaatttgctttcccccttctggcaggtagcatttgcaagggccgtgtgtttaaaaacaaaaaatgactttagtattcataatacttaggaacacgtaataaacactgaacctggttctctaccttagacttcataatttgaggagaagaaattcaatgtagtcatttttaagagatccttgtcccttcttgaggttatacaagtatcttaggacttgtgagtttttgggaaaaataaagcccagatgggtcctgtgttttctgtgggtgttgttattatttatttttatttattttattatactttaagttctagggtacatgtgcacaacgtgcaggtttgttacatatgtatacatgtgccgtgttggtttgctgcacccattaactcgtcatttacattaggtatttctcctaatgctatccctcccccatgcccccaccccacgacaggcccctattattattatttttgagatggggtctcgctcttgtcagccaggctggagtgcagaggcgcattcttggctcactgcaacctctgtcccctgagctcaagagatcctccctcctcagcatcctaagtagctgagaccccagatgtgtgccaccacgccttgctacgttattttatttatttatttttgttagagacagggttttaccatgttgcccaggctgatcacgaactcctgagctcaagcaatctgtctgcctctgcctcccaaagtgaggggattacaggtgttagccaccgtgcccggccctgtgggtatcattattgaaggtgcttttgttttctgttctggatggctcagaggtgtctcttgaagtgtcatctccgtggaccacagattcagccataggtatccacaccgatgctctagtatcatacacacactgcacaggcctgcagcagtcattgttgccattgacaaatatttgttaccaaggtttccaccccttgcagaatacccacgctagtcttgcggatgtatcatcctaggagtgggtcagttctgtattcagactccagagccgagccccctgtggcagagtaggagtgcccaaacctgcaagatcctacagccgtgcttgccatcttgagatgtagataacatttttatcattctctttaaactatttttcttattttgttgaggtatagcttatatacactaaaatgcacaaatcctaagtatacggatcaatggatttgtatacaggtatatgccttaggtaaccaccatccagatctagtcacagaacattttcattaccttagaaaaatccctcatgacctattaaagttaccccactgttggatgtaaccactgtctgatctcaatcactgtagcttagctttcctgtttttgccattcatataaatggcatgatccagaaggtactcttttgtttctagcttcttttgcccaaaatatttttgaaaatcatccatgttatttggttttaccacatttcattctatttgtattaatgtttcgtattacattgtatttgcatacagcaattatctcttttcctttttatagacctttgcattgtttccagtttgggactagtaagaataaagtttctatgagcattcttgtacaaatgtttttgtgggcatccatgagatggtttggctgtgtccccactcaaatttcatctcaaattgtaatccgcatatttcaggggagggacttagtgggagggaggtgattggatcacaggggtggtttcccccatgctgttctagtgatagtgagttctcgcaagatctgatggtgatgtaagtgacgatttcccctgctctctctctcctgcagccttgttaaggatgtgcatgcttctcctttgccttccaccgtgattgtaagtttcctgaggccttcccagcaatgcagaaccgtaagtcaattaaacctctttcctttatacgttatccagtctctgggaagttctttatggcaatgtgaaaaatggcctaatataatacatacttgtttctcttgggtataactctaagattgaaactggggtcttatttaattttattgggaactggcaaattgtgttccagagtaattgagttactctgtattttatattcccattagcattgtgtgggagttccagtcactctacatccttgccaatacgtctattattcttttttattccatcccagtctacaggaaaactggatgcttattttctccatcagagttttccgccatgttgtactttctgccatattgtatatatgttgctgttcctactggggacatatacaccaaagtttaagatcatggtttttcattttcaccctggatttctccgaactgccatccagctttccttctcccctaccttaaatcttacttactttaattctgtttggaaaagtggaaagtaatatagatcaagtagctatctcctattatattcaaagtaaaatgtatattagagaagtaggtataagaaaatcttcatttagggccaggcacagtggctcatgcctgtaatcccagcactttgggaggcagaggtgggtggatcacctgaggtcaggagttccagactggtctggccagcatggtgaaaccccgcctccactaaaaacacaaaaattatctgggtgtgatggtgcacgcccataatcccaggtacttgggaggctgatgcaggagaattgcttgaacccaggaggcagaggttgcagtgagcagagatcactccactgcactccagcttgggtgacaaagtgagactccatctcaaaaaaaaaaaaaaaaaaaagtcttcatctgggggcagtctagtgtaatggaaaattctagaattctggactcagatggccctgtcccttactgactgtgactttagacacatgatttaatagcatggaatttcagattcattgactataaaatacagagagtaaaaattcaatgacataaaggaggtaaaacagtatgctacagactaggtaattcttctcaagtacatttcaattttagtttgtatcagacaggatgtgctgtggttaccacacgcagcccccaaatctcagtggtttagcatgatggaaatttgttttttactcacattctatttctaaccctggttgttggagctctctcatcagtcacttaggaacctagtctaaaggagatgtcactttggctccaggttgcatgaataatagcattgagtgctagtgggggaagggggtatggtggtaaattcgggtgtccagtcagcaaatatgtgctgaggaacctattctgtgataaacattggaaagacagaaacaaacaaaaaatactgtacctgcttccaggagctcacagcataataacagcaataacaaggacaacagcaactgtagctgcagcagcgaaaagttactgatcacttatgaagcccagcactgtatcaagaacttattttatgatgcagatgttttcccaatcagaaaactcagataagggaaaacagaattttatttttctgtaactgaatttcattttactcttaagcacccacttccactgcaaaattgaattagagaaaatgtaatcacttctggtttaaaactcagtctcttgtggatactgctcagttgacccaactttctaccctttgcatttctctctgtctttcccactgtgtttaaagttcctggtgtgaggtgcaggctttagtattaaggcatgccagactttgggaagtatcatctgttgttacctgtccccacctagtgtagttatgtgtccctttgtttctaccactgctgattgatcgtggttctgtatctgttttggggtcaatacatccacatccctaatccccaaatgtgagaatgttttggtcctctggttctcacggccacttctgtgcccttcgtggaaacttaggtgcttccggctgctctctccacaccacactggcatgaggatctgcaaggctgccctcagtcttccccacccagaaaatccccatggccatttctactctgtggcttgggtaccatgtaggtcaaagaacttctctataaatcgtacagactcctgggaactgtagcagtggctcccctgctctgggatttccctaaacttatttatggcttctttcatcatccttaccctagaccatagttattctgtttatccaggatcaacgtatacaagtgtaatggttttaagtgaccttaaataaatgcccctgaaaagataggccaatcagtgttccagctgcagatggaaactaatcactactattttgtaatagggataataatggtgtaagttcaggactgaaatacaagcaaaggcctgaagccagaatcagtatgaattaggattctgtgtccattcatcatgaaggctgatcagttgttggctttgaacagaaggctcatgccttgattagagctgtcagtggtagggagtaaattaaaatgtgtttgtgctccactagtgtgtttgaattttaaatcactggaaatccctgtgtggcctaaactagaagttttctcatatgcaaagggatggagttggaacagatagttgatccctaagtacccttccagctatgaggtattctgtttcataataggatggtaaacaatcttaactcattcctttgtaacttaatttttctgcatcagggaagaatagcagccagtgcttggtatttaagcaaaacatacatttataattcatttatatgcagtcatatatattataaatgggaatccaaaggataccacccttaataagcaagtgagaatttatgaactcctttgcttccaacccactactattatttatcttatattaatggcctctctacccagtagactgctctaagtctattaactttcttttttaaaatggcatctttcagatttggtgcaagccattgggctgtaggctcatttgcaatttctccattttttatgaatacagtgatttatgtcacggggatgtaatggctcattttgggtctaattttgactcccacttggattcaaggcatctgagcatgtcttatgggctcaacaagcatctagttgaatgagttgattttcatgatgatgatagttgtaaggggcaattgagaaggtggtttataaatgaggccttggggagaatgacatagttataatgactgctggctttggggacagacattcttagtcccactttctatctctgtaatattgagggaggttaactagatttgaggggccttgtttatgtatctacaaaatgagcacaattataaccaagctcctatggtggtaattaagagttcaacatggtaatgtatgtaaagggacttagcaacttgccttgcacagagtaagtgttcaataaagcttagctgctattgtaatgtctaccccacacctggtcccatgaacttatttctgaacttttcatcacggaggactgtagggagaagccaacagagctgttttcacaagggaccatgtgaaatgttaaggtgggtccagaggtcctggaatttacatttaaagccaggagctaaaaaaatgagaattattactgttcctgacctcatttgtccctcgggctggtgaggcttagggtacatttatatttgctttcttatatctatacctttcttttagtcttggtgtttttcacattgacagagccacaaactaactagaaggctacatactcctcagtaagaatagctaacatttgcagcatgtactatatgtcaggcacaatcccatgtggttttacaggaatatctaatagaaccctcacaataatcttttgagggagatcattattgtataattgaaaaagcagaggcttagtgagatgaaacaatttttggtttgtatcagtcagtatgagctgtgttgtgctgtggtaacaagcagctcccaaatctcagtggtttggcataatggaaattcatttcttactcttactgtatttctaacactgactatttggagttttctcatcagtcactttggaacctaggctaaaggagacttcactttgataccacattgcacaaatgatagcactgagtgctaactggagtaaattcgggttttgagccatttattcaacaaatgtcatcaataaaagaaggagctggcattcaagtcttgcctgtctagaacactcaatcttaagcaacccattgtgaacataatcccatagccctcaaaggcctcaccttttcaccaactagttctgttccttttgtgattgatgatgcaatttcagtgttttaaatgttgtatttacattgattggggctgctgagatcattcacacaaatatgtctagccataaattccagagaaactgtgccatgcagttccaaattccttcacttctcccaccagtacaagggcttcataggagcaaagatttgcaaatgatgttcccatccaacacttaacacttcttatttttaatcgagacatcttctgctcaccacttttggcactctgcttgtgcagccttctctagtctccagacaacagctattttctctgttagccaattaccctccactgaaggttccagtatcctcatacctgcagaaaaaaattacctggaaagaatgcacttttctcagggcccagacggtgatggattgtaccatgatggtttttgttcacctacaccggtggattttcctttcctgctggaggaaaagatctcattctgcaaatgcactaatgatgtgtaattatcatcgctgcaagccttctacgcatctgggctaatggttccagcttccatgatgattctcatatgttacccaattccatatttgagtggttctgtcctgcccctggtaacagtaacagttggcttctagacaaacttaaatatcctggctttatatacctggctcatagcatgtgatgataatagcaatcaccacataagtttcaatcatatctttactcacagaagggagatactcttggttgaatatttaattcagttttgttaaaacttgaagtcttcttgaaacagcgctgcctgacagaaatatttaacgtcaggaattcatgagcaatgggaccccaaggtcaaaaaaggggaatgagtagtcaaatccagccttgcttgtcacagcagactggagcttcaggaattattaagcaggcagtgggaagaacaaaggggataatgttctttccattgaagtaatttttctcaatgcaaaatgctttttcggagtccatgtgggttaatttccacccattttgcatgtaggagacatgcatccaagtcctcagtctcagagttggaagaaatattttttctttattttccttatttctagtaaacttcaccccaaaccctcaaacagttaggttgcttaaaataaaaacaattttggtcaatactgaggcttccctacccctagagtttgtttattacagtagttattgaattgaatccttgagataggactttctgttgatgtgcatactacctgaaaccatgtgaccctcttcttctattttaacattggagcccaagacccttttgtggggttgctgtccccttaccctggggtcctgctttcagaggggtacttgatagcttctcctttgatatctaaatttcttgggtgctgctccttcataaaggccaaagttcccactgtttgcaagacactcacttcccaactgcaaccccctttccatttctaggggtggaaatcctgcctcttcctgctagttttcccttccttggtctgataaatccagttcatgtctttatcttgtgaatcctctgcaaattgctatggcaaaaatccctaagatctcttttgagatggaagaccaaacatacagcaaagaaaacacagattaataattcaaaaacatatctgccactggtaaaaaaaaaaaaaaaaaaaaaaattagaatcaaaccattaatttctccttacactttctcctgcagcagtgaatatactacaaagcttggtttctgtgataataggaataaggcttactgagctatattgcatttcctaattggatcattcttcaaccattttatctcatgggtatctaccctgccttttatggttggggtggttttcttttcctccccctcttagatcttaattttgcaaacaaggactgagaagtggcattaagatcagcctcattatcacattgcagtttggcaccttattcctctctccatctttattagcagagtctctgatttttttaagcttatttgcataatttctaacatcccgggtttattcagaaggccttttgatgaaggaatggagaaggtcttctctactccaaaggcctcttcattaggacacagtggaacacagcacctaagaacacagactccgcaggcaactgaaaagcctagatttgagttctacttagccgcttctgggctgcgtgacccttgggaagttgttcaacgtctttgaacctcagtttctccatgtgtagcaatagcagctacatctcatgaccaatctgaatcactccatggaaaatacaacagtgtcctgttcatgctattgggcgttgttatcattatccttttctctttattaatgtaaacattttactgaagaatgacgtacatacagaaaagtgcctgtgtcataagtataaagctcaaggggttttcagaaattgacacatctgagtcaccagcatccagatcaacaaacaaagcattggcaaaactcctaagagcactttcacagctctttcctgccactaaatccttccccgcaaggggtaaccactctcctgacttgtaacaattgcaggttagttttacctatttttgaactttatataaatggagtcaaacacgatgcactatttttgtctgatttccttttcctgatatttttcatgagattcattctctgttgtagtcagcagatataattcatttttaattgctgtatagtgttctattttgggaatatgtcacaatttttatccattctacttttggtggacatgtatgttgtttctgattttgggctatgaaatatagcaatgctatagtatatctaatgcatatattttggagaatttgtatatgtatacatttttataggcatatatttaagcatgaaattactgagtcacaagttatggatctgtttaactttagtagacactgtcagtgttcccaagtggttgtaaaatttacactccctccaacaatgaaaaataattccagttgatctacattctcaccaatgtttggtatcattgattttgttcattttaaacaacatggtgggtgtgtagtcatattgtgggttatccatcagatagctgatattttattttttcaacttttcatttggaaataatttcaaacttacaggcaagttgcgagattagtacaaaattgtatgctcttcacccatatacatcaactgttcatcattttccacatttgctttattttctctctgtaggcgtgcacatactgctttttaaaaatatgaggtaagtttcagatatcatgcctcatttaccactaaatgtttcagagtgtgtgtaccaagaactatctcttaaataaacacagtatagtaatcaaaatcagaaaaactcaccactcatacgatataattatgtaacctgtagatcttattaaaatttttccaaatattcctgtaatgtttttgtagcatttttttcatgctctggatttaatccaggatcatgcattacatttagttttcatgcctctgtagtcttctttaatatggaatgtttcctgtctcttgtcgtctttcaggatattcacatgttatgaagagcataagaattactgtaattttggcttattggatgtttcctgatgagattcaggttatacatttttggtgaattattatataagtgatagtgtgttcttctcagtacatgacgttggtttgttctgtcactattgttgttgactttaatcactttgtcaaagtaatatatgctaaacttcttcactataaaattactttcatccccttgtaattaataaataactttaggggatatactctgaggctgtgtaagtatactgtacttcatcaaactttcatgcacttatctcagcatctattgatgatacttgcctgaatcaattattactatgatggttgcaaataactttctaattccattgctcctccattaattagtttgcattctacagtaaggaagtgctttcccttccctccattaattaattaatcactcatcacaatagagaaataaagacattagactaagaagagcaacacagtgatatatgctagaatagtgggcatgacaaacgaaacagcacttgagatctgaaagacagctaaaaattaggctatcaaagaggaccagaaaaaagtgaggcaataggaaaagcacaagcaaaggctgtgagttcaaagacagcctgagaaaaattcaccatggttggggtgtagcaagtaaagggagacaagtgaaggttgaaagcctggaaggaaagcctgaggcaatcattaagattaactcctcattcatgacagtgggtttctctatttggaaagattttttttcactgtgtctgcctgcgtcaggcccacccatactcaaattcttatctatttcttttaactattgcttttaaacagaaaatccccaagtttagtggcttaaaacaatgatttattatgtcttgagcttttgtgggtcagcagtgggggcagggttcagcagggtggttcttccactccatgtgacattggctgaagtctcttacttggctgccttcttgattgcctggactgggtttggaagtccaagaaacttctctcacatttctggggacttggtgcctcttcacatgacctccctctttccatgtgatagttcatatgttagtagtcaagcccatgcatctttacagcatggtgggtcctcctaagagcaacagtgggagctgccaggactcataaaggttattactgacacaagtcacttgcattgcattctattgacaagttactgggccagcccagatttcactgggagaaaaaaatggatttcatcctttggcaaggagggaaggaatcttcagagacaatctatcatgccacctctttcaggaagtcttccctgacttctccaatctcattttctaccaatctatcaatcacagttattgttctgagcctttgttaggctcattttatatagtgctttgtggtatttccaaaatttttcaagtgtcaatattttagctttactgattcctgaagtagaacctcatttacttaagtgcagtaattaataaatttggataataataggctgtcatttatggaatgataaccatgcatctggcctatgcaagatactttaccttaattatctaattatatccgcttaagaagataaaactgtctttattttttaacagaaagaaaaccaagtcccagaaggaaaacaaattgcttaaggttgtctgacaaattaggggtagagtcaacattgaaaccgaggtctgtgcaattctaaaattgtgttgcaatcttcctacatataatcatttattgagcacaaactatgtgttagtctccttgcttagcactagggattcagaaatgtgtaaatgcccttagtctaacagagaaggaagatgtgtaaacaaacactgactactcagtgtttaaaggcacagcatgttaaatgctagagtggagttctgagactccagaccagggttcatcaaccctgccaggaaaggttggggaaggcttgaccatggcagggacatttgaattgcagcttgaaggataaataggaattcactaaggagaggaggaggggaggggaggggagattgatgggagatgaagttggagaattaggttccaattgtaaagaaagggaaggaaaggaaatcattgccattgagcatcccttgtaagcttgtcccattgaatcctaaaacctgctctgaaagtgctattctcatattcccgttctcatagataggaaagcgaagctaagagagatcaaatcatataccaaaggccgcattacatagtttggactttatcttataggtatcaggaagcgaacacactttcaaaaccagcgcatgacctgacctgacagagaaatgaacattgttgtcatatagagatgggaaagagtgggtagagggtagtagtgtacagaccagatttagggggttgttcctactaccagccatgaattgatgaggaccttgatgaattcaatggtaacaggatggagaggaggggctgaacagaacttagggtagtgtttatgaggtataaataatgagactgacgcactggtaggatacaaaaatgaagggagaagagtcaagaattcaaagcttctaggtttggttgatattttcatcaaaggggttatgggagtcacagagctcaactgatatcccttagttgcttcacaaattactctctctctgaatctcacttgtccatacctgaaaatgcagataagataatagtgttacctacctcattagctgacttaaatggagctaacacatgaatggtgctgagcacaaagctcggctcatggcaatgaatatcaactctcattcattcaatgaatatctattggataccttccacaggccaggaactctcttaggtcctaggaagacagactataaataagattctcaaagttcctatgcttacggaggttacattcgtattacgtcttgttcttatacaacacataataatacaaaagttaattgcagagaatagtaaatatacaaaggaagcacataggctaagagataaagggaagctgtcaagggcgctttagatggggaatgggttcttaactgtaagtgacctgccccaccgtcacccggcggacatttggcaatgtcaagagacatttttgatggtcacagcttggaggcaagtgctactggcatctagtaggtagaagccagggatgttgctaaacaccctacagtgcacagaacagccccccagtgcaaagaatgatctggtctcaaatgtcaatactgctgagattgagaaaccctgagacagggttatgaaagagtcttttcagtgagggcatatttgggctgaaagctcagggaagacaaggaacaggtggtgagaagagctgaccagagagcatttcagaaagaggaaagagtaactgcaaagtccagaggagggaaagaacttcttgtattcagggatcagaaaagagactaagtggctcgaacgctgtaaggatgggagttggcacgtgcagagattagagaagttagcagctggatcatgcaagatctcagaagccacataaagagtttgtcttttgttctaagaatactaggaagcctttcgagcacgttgaaataagacacaccccctgttcagttttacatttcacattttaaaaaactcatgctggctgcattgtggattaaagagagtcaaaaaaaatcagaaggctgttgcagtcactcatgcaagagatggtgacgatgaagctagcgttttatcagtggaggtggagagaaacggacaggttagaaatatgttttgaaggtagagcagacagcacttaaagacatcagatcccaggggtgaggggaatgagaaatcaaggatgactcctaggattttagcttgaggcactgagtaggtggtggtggtattcattgcgttggaaagatgtcagaaggaacaggtttgggaggttgttttggacttacaggtttgagatgctaatttttaatcccagtgaagacgcaagtatgcagacagctggatatacagagctgaagctaccaggggaggtcagggctgtaattatacattacgacatattttataatataattccttcttgccgaagtctccctgcatatcatcctgcatgcagatgtctgaagtctcaaggaggcattttctcagaatcattgccaagcccaacactgtgatatttttaaagtgtcacatcctccatgcccctctttgaattgagtcacatgtttaattaagtttccacttacaacccaagtaaaggggaaaaataaccctaaagaattgatccgtgcctgcagagctttggaattttgggtggctaccctctctgcttctctcttccttttttctttctttcttctttttttccccacttatttgctagggacattttcattctcaagttgcgattagttttggaaatgggggtcttgcagtagagagtattgaggaagccctgtccttaagaagtcgtcttcacagatgatgacaccgaatggctgaaatgcagcagaaggatctctgggttaagattcagaagacctgagccctcagcttggtctgaccacatgctgaccatgtcaactcagggcatggtctcagcttcccgttcttttgtaaaaatgggagagaatccccaacagatgtgagtctttgtgaaaatcatatgagatcatatgtctaaggtctggaaagcatgcacattttacaaaagccatcacttcccaccccctccgtcaacaccaccctagtccaagcctccgtcatatgttcccctcattactacaatagtctcctgactgctctccatggtactgcttctgcccactccccctgccagtctgttcttaacagccagaatgatgccatgaaaatatgtcacatcatgtcacttccctgctcaaaaccctcccactcatatcccactcacctcccactcacggtgacatttggagtccccatgcaacgctactcaccattcaacagctctcactcatatccactgctgggtccacatcagccacacggccttcctgatattcctggaacacattaggtggaatcccaccctgaggcctttgtacttgctgtttcctctgtctagaaagtctttttctcagatagccacatgcttccaatgccttcttcccagggaggcttttcctaatcactttaacacagattgccgtctctccctcctgccccacatgcactacattctccttctatactttaattcacagccttttacttccaaacatttcattttccttttcttccttttttttttttttttttttttttttttgagagaaggtcttactctgttacccaggctggagtgctgatcatagctcactgtagcctcacattcctgggctcatgtgatcctcatgcctcagcctcctgagtagctgggactatagactcaagctaccatgtcaggataatttttaaatttttctgtgaagacggggactagcaatgtttcccatgctggtctcaaactcctggcctcaagcaatcctcctacctcagcctcccaaagcactgggattacaggtatgagccaccacgcccactagcccattttctttatatcttctgtgtttcatccgtcttcatctgatgaaaagtaagctcagtgaaggacgggatttttctccgcattttgttcaagactgtattctgtagcacctacaacagtgcctggcacagagaggtgctcagtaaatatgaagaatggacagatgagaaaatggaaacacaaagaattaaaataacttgcccaaagttacagatgggaaaagggtgtgttcacattcagacacctccacttcctcaatggacagttgaaggtgatcatatctttcccggtttcctcaccggtcattgctagaagccaaaggaatgcgtgcctcgtcccctcagagagcgcacactaccatacagagtacgtggaattcagtgaggccatgagagggtgccattaatagacttgtgtgtgtgtgcctggagtacatccctttggctcatctaatttcagaagtggacaacttcaagcatgctccaggtgtctcacctctgagctatatacaggtatatacacctctgatacatatacctgtgtatatcccagcttttctatccctgggctttcttggagcaaggaagtttagtccatgtgcagaacagcctggctgtgagcaggagaggatgttcccggggcacctgtccctcaaccagtgggtgtgggtggataaatgtcccaaggtcctaccccttgctggggtgaatctgcagcacatgctatgtggcatgtacctgcattacagaggatctttgcaggattgcacccctctgtttttcactcctggctcttaaaaagtcgcctccaaaacattacctgtctccacacccatgttgcagactttgctttcaaggaaacccaaactaagagagtgcctgcaaaggggagctcgggatttgggttcaaagtttcaaatcccagtttggctatttgcccttgtgaccctgagcatgttccttaatttcctcaaagttccccagcaagtggagacactaatatgaagcttgcctgcttggaggaagaaggaatataggcagtgacctgtcccgatgcctgagatataatatgctattaaaaaatggatgctgatattattataattacacaattgtaattattgatatcaatagttattataaatatgtatttttgtatgtgttcatgatgtgatcggtcatgttcatgtgtatgcatgtgactcaacattcttattattcatctttgtcattcaagttaagaaagaggacatgggaaggcaaaaaaggaggtatatcctaagggaggagattaaaggacccctagactccacaaattcctaagctgtcatggtagagagcagtctactgctttttgaagctcttgtcaacccctcagcatctatacttctgacatattccatcaacctgtgtattaatatggctcatatttctaacaagtgctcacatggtgctttcattctggcagaaactgttaaaacttctctacacagaaagttctttatccctatgtcacagatgaggaatgtgaagcccagagacgttggccaaccttcccaaggtcacacagctaggaaagggcaaagctggatttggacctaggtggtctggcttcagagtccatgctggtaacccctctgctgtattgcctctttgcacaagatcagcagaacctagggagcaatttcgctgccatcccagcagcctaggggaaaggagacatcatagtttccttatttgataacttcataaacgatagcatttagtgcaaagcagcgaggtactccagaagaagcccaatctactcatctctgcaaattccatagatggccttgtcatgatgtctgggttgctgtgatctccacttctgccttcagtttgttcccatggccagatgaaaccccttggaaagaacaaaactattatattgctggggtagagaagagtgtagttttacagaagctgaatggcgtggaaccatgcagcttaaattatcaggctgtgatggctcctatcacctagcaggtggagagagaacagcagatagaaaagactgacttctagcagctactgaggtctcttctccttgtcaacagagacttagatggtagatttgaagtggaaaatgggaatttgaaaattagagacaaagaatggcaattagtttagctaaggcaaaaagatgggatttttaaaaagcaacgttttgctaagtcagtgctggggaacaattttatcaggaagtaaaaataaactctggtttatatgtattatggaatgtgttatgtctcttctactgcatgttgatggctacgtgagggcgagagctatgctggggaccaactggaggtgctatgtggagaatagggatgcaggatgtggaatcaaatggtctggattcaaatcctggctcttagcagctgtgcaggctcaagcagattttgaatgctctctaaacctcagtttccatgtctgttaagtggataatttgccttttctgtagggttatactgaggattaaatgacataatccacatatatttagcacagtatcgggcacatggcaagctctcagtatttgataactgttatgacgacaaagttataaaatgggtgaagtcctgtgtcttgtttcaaagatggatacacactgaaaggatgaacaacaacaatggtatataacagcatcaaaaagaagtctaggccaggcgtgatggctcatgcctgtaatcacagcactttcggaggctgaggcaggtggatcacctaacgtcgggagttcgagaccagcctggccaatatggcaaaaccctgtctctactaaaaatacaaaaattagctgggcatggtggtacacgcctgtaatcccagctatttgggaggctgaggcaggaaaattgtttgaacctgggaggcagaggttgcagtgagccgagatggtgccattgcactccagcctggttgacagagcgagactccacctcaaaaaaaaaaaaaaaaaaaaaaaaagatttacacaggagaccatgaaacttactaattgtttttcctactgaagatttttattcattatgtatagcataattgttaagaatattgatcttgacatcagacaaacaaggctttaaattttcattctatttactcaccgtgagcagtcagttgatctctctgaaccttagttttcttaaccataaaatggggatgatagtaccaaacccctggggttgtatgaggattaactgagaaagcagataaaaagcattttgcatgtgaattgatattattgataatattataaacatgaatatgtgaatgtgttcatgacttttttccaggtttatttaaatataactaaaaaatattgtatacattatggttcacaatgtgatattttaatagatgtacacattgtgaaatgattaccacaatcaagctaattaatatatctgtctcctcaaagacctaaaaatggaaataccatttgacccagcaatcccattactgggtatatagccaaaggaatagaaatcgttctgtcataaagacacatgcacatatatgtgcgttgcagcactatttacaatagcaaagacacggaatcaacctaaatgcccatcaatatagactggataaagaaaacgtggtacatatacaccatggaatattatgtagccgtaaaaagaatgagatcatgtccactgcaggaacatggatagagctggaggcaattatccttagcaaactaatgcaggaacagagaaccatataccacatgttctcacttataagtgggagcttaatggtgagaatacatggacacgtataggggaacaacacacagtggggcctgtcagagggtggagggtgggaggaggaagaggatcaggaaaaacaactaatggatactaggcttaatacctgggtgatgaaatgatctgtacaacaaacccccatgacacatatttacctatgtaacaaaactgcacatttgccccaaacttaaaagttaaactatatatatatgtgtgtatatatatacatatatacacacatatacacgtatatatacacaatatgtatatatgcacatatacatgtatatatagtgtatatatagtatatatacactatatagtatatacttatatataatatatgtatacatatactatatatacaagtatatgtagtatatactacatatacttgtatatgtagtatatactacatatacttgtatatgtagtatatactatatatacaagtatgtatagtatataggtatatatagtatatacatacttgtatatatagtatatatgtgtatatgtgtgtgtatatatacttatatatacatatatacgcatgtatatacacatatatacatgtgtatatatatatttacattgtgtgtgtgtgtgtagtttgctaaggataattgcctctagctccatccatgttcctgcaatggacatggtctcattctttttacagctacatagtattccatggtgtatatgtaccacgttttctttatccagtctatattgatgggtattaggttgattctgtgtctttgctattgtactatatatgtagatatatacacacacatagtatatatttatgtttactatataaatatatatagtatttatatatactatatatatttatatatagtgtatatacactatatatttatatatagtgtatatacactatatataaatatatagtgtatatatactatgtatttatatatagtgtatatatactatatactatgtatttatatatagtgtatatactatatattaaaaatataccataaataaaaaatatatataatatacatatacactatatatagtatatatacacactatatatttatatatacactatatatactatatattatataaaaatatatactatatattatatataatatacatatacattatatacagtgtatatatacactatgtatttatatatactatatattatatacactatatatttatatatactatagtagtgtatatgtatactatatatagtgtatatatactagtatactatagtagtgtatatatagtgtatatatactagtatatatactagtgtatatatactagtatatatactagtgtatatacactagtatatatactagtgtatatacactactatatatactagtgtatatacactactatatatactagtatatatacactactatatatactagtatatatacactactatatatactagtatatatacactatatatatactatagtagtgtatatatagtgtatatatactctatatatatactatagtagtgtatatatagtgtatatatactagtatatatacactatatatatttatatatatataaaatcacctcacatacttaatattttggtggtgagaacatttaagatttattcttttagaactttcaagtatacaatacatcattaactatagttgccatgctctacattaggtctccagaatatattcattctgtttaactgaaattttgtatcctttgaccaacatttccctattctcccacctccaccccaccccaagcccctggcaaccaccattgctttccttctactctttgcttctgagtttgacatttttagattccacatgtgagtgagacaatgcagtgtctgtctttctgtgcctgacttatttcacttattataatatccaggcccatttatgttgttgcaagtgacagaatttctttttttaagtctaaatagtattccattgtttgtgtgtgtgtgtgtgtgtatacacacacgtttatacatgtctatccgtgggtcaatggataaagaaaatatggtattcacccattaatagacacttcagttgattccgtatcttgactattgtgaatattgctgcaatgaacataggaatatagatatctcttcaatttcatttcctttggacatatgctaactagaagactagaagtgggattgcaggatcatatggtagttctatttttaattttttgaggaatctccataatggctgtactaatttacattcccatcaacagtatacaagggttccttttctccacattcttgtcaacacttgatatcttttgtcttgttgataatagccattctaacaaatacggggtaatctatctcattgtggttttgatttacattttcctgatgattggtgatgttgagcattttttcatatacccgtcagccacttatgtgttattttttgagaaacgtcttttcaagtcttttgcccattttaaaattgggttgttgtattgctattgaattgtttgagttccttaaacatcttgcatattatcctctcatcagatgtatggtttgaaaatattttcaccctttatatagattgtgttttcattctgttgattgttttatttgctgtgcataagctttttagtttgatacaatctgatatgcctattgttgctttttgagtcatatccaaaatatcattgcctggaccaatgtcaggaggatcttttcctgtgttttcttcctgtggtttataggttcaggtgttatgtttcaatctttaattaattttagttgatttttgcatgtggtgtgagataagaatccaatttcattcgtctgcatgtggatatctaatttttttcaacactacctattgaagagacagacctttcccttgtatgttcttggcatcttggttgcagacaaattgaccataaacatacgggtttttatgggctctttcttctattccattggtctatatgtctatttttgtgccagtaccatgctgttttgattaagatagctttgcattatggtttgaaatcaggttgtgtgatgctttcagctttgttcttcttgccgaagactgtggtggctgctcaagattgtggtagctatttgcagtctttgatgatttcataccaaattttaggattttttttctatttgtgacaaatgccaatgacattttcataggaatggcatttagtctatggataactttgggtattatgaacattttcacaatattaattcttccaatacataaacacagactatcttttcatttatttgcatctttttcaatttctttcatcacagttctacagtttttagtgtacaaatcttttacctccttggcaaaacttatttctaagtgtttcatttttttgtagcaattgtaagtggacttttaaaaatgtttttggattatttattagtgtataaacacactattgattttgtatattgattttgtatcctgcaacattacttcattaattagttctgacaattttgtgatggagttttaggacttcataagattatgttatctgcaaacaaagataattttatttcttcttttccaacttgggtgccttgtattcctttcttttgcctaattggttgggctaggacttccagtactatattgaacagaagtgtcaagagtggacattcttgcagtgagccgagatcgcaccactgccctccagcctgggcgacagagcaagactctgtcccaaaaaaaaaaaaaaaggacattcttgtcttattccttgtctcagagaaaaagctttcagctgttcaccagttcaccattgagtataatgttatctgtgggacattattatgctgaggtacattctttctatacctaatttgttgagagtttgtagttaggaaattacgttgaattttttcaaatgcctcttctgcatctgtggagatgattatatgatttttatactttattctactaatgcgatgtagaatacttactgatttgcatatgttaaactattcttgcatcctgagataaatcctaattgatgatggtgtataatccttttcatgtgctgttgaattcagttggctagtattttgttgaggattttatctatgttcctaaagcatgttgatctatactcttccattcttgtagtgtacttttctggctatggtatccgggtaatgtcagtcttgtaaaatgagtttggaagtgtttcctgttctttaattaaaaaaaaaaaaaaaagaaaatgtgttgttaattatgctttaaatgtttggtagaattcaccagtgaatgtcttgggtttttctttgttgggaactttttgataattgatttaatctccttactgattgttggtgtgttcatattttctatttcttcataattcagtcttggtgggttgtatgcatctagaaatgcattcatttcttctaggttatccaatcattcatagtatctcttatgatgctttatatttctatatcagctataacatctcttttgtttataactttgagttccttttttcttagtttctcaatttagtttattttttcttaaaaaaaaaaacaactcttagtttcattgatattttctattgttttctaccctctttccactgactttgggcttagtttttcttcttttctagttctttggggtataaaggttggttgtcaggttgtttacttgagatctttttttccttaatgtaggtatttagcactataaacttttagaactgtttttgctgcattccataagttatggtatgttgtacttctgtttcattcgtctcaagttatgttttgatttctcttttgatttcttctttgactcattgattgtttaggagcatgtcatttaatttgtcagtatttgtgaatttccctattttcctcttcttacgggtttctaattttataccactgtaattagaaaagatgcttgatatgatttcagtcttctcaaatttattaagatttgttttgtggcataatcctcccattctggagaatgtttggtgttcacttaagaatatttattctgttgctgtttgatggtaggctcttcttgtctgttaggtccatttggtttatagtgtttgtctgttattttcttattgatttttctgtgtgaataatttattgttgaaagtgaggtattgaagtctcctactacttttgttcatttagtttggtttgttacatagatatagtgcatgatgctgaggtttaggggatagatcctatcacccaggtagctagcatactacacaataggtagtttttctttttttttttttgttattatactttaagttttagggtacatgtgcacagcatgcaggttagttacatatgtatacatgtgccatgttggtgtgctgcacccattaactcgtcatttagcattaggtatatctcctaatgctatccctcccccctcccccaaccccacaataggccccggtgtatgatgttccccttcctgtgtccatgtgttctcattgttcaattcccacctatgagtgagaacgtgcaatgtttggttttttgtccttgtgatagtttgctgagaatgatggtttccagtttcatccatgtccctacaaaggacatgaactcatcattttttatggctgcatagtattccatggtgtatatgtgccacattttcttaatccagtctatcactgttggacatttgggttggttccaagtctttgctattgtgaatagtgccgcaataaacatatgtgtgcatgtgtcttcatagcagcatgatttataatcctttgggtatatacccagtaatgggatggctgggtcaaatggtatttctagttctagatccctgaggaatcaccacactgacttccacagtggttgaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgaggagcattttttcatgtgtctgttggctgcataaatgtcttcttttgagaagtgtctgttcatgtcattcgcccactttttgatggggttgtttgtttttttcttgtaaatttgtttgtgttcattgtagattctggatattagccctttgtcagatgagtagattgcgaaaattttctcccattctgtaggttgcctgttcactctgatggtagtttcttttgctgtgcagaagctccttagtttaattagatcccatttgtcaattttggcttttgttgccattgcttttggtgttttaggcatgaagtacttgcccatgcctatgtcctgaatggtattgcctaggttttcttctagggtttttatggctttaggtctaacatttaagtctttaatccatcttgaattaatttttgtataaggtgtaaggaagggatccagtttcagctttctacatatggctggccagttttcccagcaccatttattaaatagggaatcgtttccccatttctcccatttcttgtttctgtcaggtttgtccaagatcagatggttgtagatatgcggtgttatttctgagggctctgttctgttccattggtctatatctctgttttggtaccagttacatgctgttttggttaccgtagccttgtagtatagtttgaagttaggtagcgtgatgcctccagctttgttcttttggcttaggattgacttggcaatgcgggctctttgttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttctttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgtttttggtgtataagaatgtttgtgatttttgcacattgattttgtatcctgagactttgctgaagttgcttatcagcttaaggagattttgggctgagacgatggggttttctagataacaataggtagtttttcaactcacaacccctttcttcctcccaactttagtagtcaacagtgtctattgttctcatctttatgtccatagttacccaatgtttagttcctacagtgtggtatttggttttctgttcccgtgttaattgttaggattatggtctccagaagcctccatgctgctacaaagaacatgatttcatccttgtttgtggctgtgtagtattccatggtgtatgtgtatcacattttttcatccaatacaccattcatgggcatctagatggattccatgccattgctattgtgaatagcactgtgtggaagaaatgagtttatgtgtctttttggtgggaagatttatttttctttgagtatatacccagtaatggcattgttaggtcaagtgatagctctgttttaaattctttgagaaacctccaaactgctttccacagtagctgagctaatttacattctaatcaacagtgtataagcatttctttttctccacagtctcaccagcatgtgttatttgattttttaatagccattctgactcgtgtgagatgttattgatttgcatttctctgatgattagtgatgatgagcattttttcgtgtttattggccacttgtatgtcttctgtcttcttttgacaagtgttcatgtcctttgcctactttttaatgtggttatttggtttttgcttgttgatttgtttaaggtccttttagattctggatgttagacttttgtcagatgcatagtttgctagtattttctccaatgctgtagattgtctatttactttgttgatagtttcttttgctgggcagaaactttttagtttaatcaggccccacttgccaactttgtttgttgttgttgttgttgttgttggaattgctttcagggacttagccaaaaattctttgtcaagactgatattgagaagggtattccctaggttttcttttagaatttttataatttgaggtcttacctttaaatctttaatccatcttgagttaatttttgtatacggtaaaaagtagcgttccagtttcattcatttgcatatggctagccacttatcccagtaccgtttactgaatagtagaaagtccttgccctgttgcttgtttttgttgactttgtcaaagattagatggttgtaggcgtgcggctttatttctgggttctctattctgttccattggtttatgtgcttgtttttttttcaccagtaccatgctgttttggttactgtggccttatggaataattagaagtgtgatacgtctggctttgttctttttgctttggatcgtttgggctattcggtctcttttttggttccatatgaattttggaatactttttttctaattccatgaaaagaacatcggtagtttcatataaatagcattgaatctgtaaactgctttgggcagtgtggccattttaacaatatcgagtcttccaatccataagcacagattggtattccatctctggtttctttcaacagtgtttcgtagttcttgtagagatctttcacccccttggttagctgtattcctaggtatttccattttttgtgtgtggctatcataagtgggattatgtttttcatttgactatcagcttgaacattattggtgggtagatgctactgatttttgtacattgattttgtctctttgtccttcttaatagttgtttgtttaaagtctgttttatctgatgtaagaatagaaacctgctctttttattttcaacttgcatggtagattttttttttttttggtccctttactttaagcctgtttatgtcccttcatgtgagatgggtctcctgaagacaggagagaggtggctcttgtctttgtatgcagcttgccactttatgtcttaagtggggcattaagtacatttacattcagggctattattgatacatgagactttgatcctgtcattgtgttgttagctggttattatgtggacttgtttgtgtagttgctttatagtatctatgggatatgtgcgtaagtgtgtttttgtaggagcaggtgccatttcttggtttccatgtttagcactttttaaaggaactcttgtaatgcttgtctaattgtaaccaattccctcagcatttgcttgtctgagaaggattctatgtctcctttgattatgaaactcagtttggcaggacatgaaatttttggttggaatttctttcctttaaggatgttgaaaataggctcccaatattttctggcttatacgttttctgctgagaggtctgtctattgctagcctgatggggctccctttgtacatgatctgatctttctctagctgcctttaagatttttttttttttttgcatttatcttggtgactctgatgactgtgtgtcatggggaggggcatcttttgtagtatctagccagggttctctgtatttcttgaatttgaacgtcaatctctctagtgagattagagattttttttgtggactatatcttcgaatatatttttcaagttgcctactctctttcttcactcaggaatgccaacgagttataagtttggtctgtttacctaatcccatatttcttggaggttttgtttatttttttaaaattcctttttctttatttttgtctgactgagttaatttgaaaaaccagtgttggagctctgagattctttcctcagcttggtctattctactattaatgccttcaactaaattaagaaattcttgcagtcaacttttcaattccagaagtttagtttggttctttcttaaaatggctcttttatctttcagctcttggattattttactggattctttggattgagtttcaacttgcttctgaatcttgatgaacttccttgccatctatattctgaattatatgtctgtcattcagtcatttaatagtggttaagaagctttgctgaggagctagggggctcatttggaagtaaggggacactgtggctttttgaattggtagagttcttgcactgattcttgcactgatctgggagggctggtgttccttcacctgtggtgtaagttgagtattttcagttgggctcatttctggatgtttttagagggccaagactctgtacaggatctttatttgtgggtgaatgcctgtgcttggtttcacaggggtattagccaaataatttttggcaatgtagtttgagccatgatccagtagatggtgcttaaaagtaatggccagcaggtagggtcttagccacatggctcttttatatttcctcacgtttgcaggcatgctctgccatggcaaagggaggtggggagagatgacctcctcaccagatccactcctaggccttcgaggattcccctcttatcactggctccacacccatatttattttgttaggtgttcagggccgcagggctcccttgggcagaggctgtggcagagagacaggccacattctttctggactggccctatagagggaggtatgcctcactcccttgctggcccatgaacttggacattttaccattctcaatgctctgagtgtgggggctcctctcccactcaagtgctggccacagatctcagctcaacactcataagctgtgtaccatggctgagacatcaggatggcccaactgtggtggtggattcgaagtgctcccaggttgctgggaaagtgttcaggtggagcaaagcactcaggctgggcagtggaggctgtgctatgcagcctgtgctgtgcccgtggtcctgtggggcaggcaggcaggagtcctgggaaaggctagtgggcaggaaggcttatagaacagatgttccccagtcctgtgggaaggctgaccctgctctcttctggcctggtggtcaactggggctagaacctcttggagggagatggggagcactggggtatgcgtgtctgtggctacactctgccagaactacatttctgggttctctggtggctgaagccctgactctgcctattccctgggcagatccccctgctagctcacatgtccatggggaatgtggggccccctgtcctattacttttgtattgctgtctgcttctccctttagttgtgttaatatttgcattatataattaggtgttccattgtttagcacatatatatttaaacttattatatcttcttaagtgaattgactcttttatcattatttaatgaccttttttatctctgtcacagttttggacttaaacatctatttttttttcctgatgtacatatctctgcttttttgattactattatattttatttattacagcttatagaatatctctttacatcccataattttcagcttatatgtgtacttaaagctaaagcaaatctctagtaggcagcatgtagatgggttttggctttttactccattcagtcactctgtcatttgattagagaatttaactcatttacatttaaataataattcataggtaaggacttactacgaccatcttgttaattgttctctattttgtatttcttttgtctcatccttcccctcttgctatctttctttctgttttttgtttttgtttttgtttttttttgtagaggtatgctttgattattttctctttatcttttgtgtataccctacatattttttctttgtggttgttatgaggcttacataaacatcttgtagttataatagtctatttgaagctgataactacttaatttcaactatatacataaatatctacagtttaacttctccttcccccgtatttgtgtcattgatgtcacaatttacatcttttatgtatcatgtatccattaacaaattattgtacctatatttttaatacttttgtcttttaacttatatagcagagtcagaaattatttatggaccaccattacagttttagagtattctaaatttgactatattcttacctttgcagtgaattttatactttcatatattttcatattgttaacatccttttctttcaacttgaagaacttcttttagggtttttttttgtaaagcagatctagtggtgctgagtccccacagcttttgtttgtctgggaaagtctttatcttgccttttgccttcattttggaatgatgactttgctgggtatacattcttggtcgatagttcttttttttttttttttttttcccagcacttggggtaatatcatctcattctctccttgcctgcaaggtttctgctgaggagtatccttaaagttttagggaggtgcccttgtatgtgtgatcagttgcttttctcttgcgactttcaaattgtctctttgacttttgagaattttattataatgtgtctcaatgaacatatctttatagtgaacctacttagagttctttgggcttcatggatctggatgttcatgttcctcttcatccagacataggaagttttctgtcattatttatttaaataagctttttgcccttttttttctttttcttctccttctgaaactctcatcatgcatatattggctcacttaatggtgtccatagtcctgtaggttttcttcctcattttccctcagtttcattctttttgtcaccttaactgggtaattccaaaggacctgtctttgagctaattcttcttctgcttagccaagtggatgttgaagctctctgaaagttttcagctcaatcattgcgttcttactcaaaaatttctgtttggttctattttttttatttttatctatttactgaacttctcactttgttcatgaattattttcctgatttgacatagctgtctatctgtgttcttctgtagctcactgagcttctttaagatgattattttttattgtttgtcaggcaatttggagatcttcatttttttagggttggctactggtcctttattttgtttctctggtgatggtatgtttctccaattacacgtaatcctgtagtcttgcattagtatctgcacatttgaagaggtagataccactttcagtgttttaaggacaggctttggcagagaaagcactttaccagttagcctgtttagagactctggtcaggccatcttgcagggttcatgggttgcctgctgctggaatcctcaggtgggctgggagcactgatgtctactggagtgggtctgaaccttgagtctcttggagcctgggcctctggagacaagcctggagcctgggatgggcctggaggctgagcccacagtagtgggcctgggtcctgggccatcaggagcagtcatagaggttggatttataaggggctagcctagtgctaggtgggccaagagcctaggtctggagtggtcagcctggagcctgggcctgcaggtgctggcctggtgccttgggctgtgggagccaacatagtgctgaggtaggcctggaggctgagtctacgggggcaggcctgagtcctgggtctgtggcagtcatcctagagcttggaactataggggattctctggaactagggcttggtccccaggctggggcaagcctggagcctgagtctgccagggtaggtaggcctagatccatgggattatgagggctgacctggtgctggggtgggcctggaggcttgatctatgggtactggcctggggctcaaggccatggggctgacctggtgccaggtttcactggcacaggcctgatgtttgggtctgtggtgaattcacatgttcacttcactctccttcccccacagggagcacacgtgtctctgcactgtgctggggttgggaagcggtggtgtggataatgtgaaactgtccttattaccttcttcagtgcatttttttttcttatttgtgtgctacacctaggtgctgtaatctctcacttgaatctcttagctcttgtgaaggtatttttatgcatagattgttgtttaaactgatgtttctgtgaggggatgagaaccagaaagttctattctgccatcttgctggcatcgctcccctagggacctgttcatgaattcgtgaattcgtatagcgtgtaaaagtattattttacacccaagataatcaattttactagtttgtgttcgggtctgcatgatggaaatcaatcagccaactctgagtggcagagtctgttacattggtgttaaaaaccagtctatgttatattggtgtttaaaaagattctgaggtcacatttgggattagtaggaaagaatgctttgattgattagtgatgtcttccattggcatggaaatggagagggacacttttttgagacaggctctggctctgttgcccatgctagagtgcagtggcacaatctctgttcactgcaacctctgcctctcgggctcaagtagtcttcctatctcagcctcctgagtagctgggcccacaggtacgcaccaccacgcctggctaattttttcttttttcttttttctctctttttttttttttttgagacggagtctcgctctgtcgcccagcctggagtgcagtggcgcgatctcggctcactgcaagctccgcctcctgggttcacactattctcctgcctcagcctccccagtagctgggactacaggcgcctgccaccatgcccggctaatttctttgtatttttagtacagacggggtttcaccgtgttagccaggacagtctcgatctcgtgacctcgtgatccgcctgtctcggcatcgcaaagtgctgggattacaggcatgagccaccgcacctggccctggctaatttttttctatgtttttgtagagacatggtttcgccatgttgcccaggctggtctcaaattcctgagctcaagcaatccacctgcctcggctatctctcctgttccccatccctcaatctctttctgtctcttgttcttgagtgtgtcttttttagatcttgttctccctttgacagcttcctctttggcttggcattttatcatttttcttagcagctgggattctctggcatttctaagtctattttaaacactttgtaaggtttgatttagaggaaaatctgatttccatagtttgtgcattggtacctcaggggactcttagtttgattatgtcctgaaaaggttgtgataagctcgggctctggcagccctgataggcgtggctcagtggcctttcagctgcttccatctgggttattgaagctttttagcagcccaagagcaccaggctctttacctcattgtagagttccagtctcatttttgttttgccagaacccctggggaactgattaagatgattctgatttagcaggtctggggtgagacgtgagattctgcatttctaacaaacagacgtgagccaggcgcggtggctcacgcctataatcccagcactttgggaggctgaggcgggcggatcacttgagttcaggagttcaagaccagcctgactaacataaagaaaccccgtctctactaaaaatacaaaattagccgggcgtggtggcacacacctgtaatcccagttacttgggaggctgaggcaggagaatcacttgaacctgggaggcagaggttgcagtgagccaagactctgccattgcactgaagcctgggcatcaagggcaaaactttgtctcaaaaaacaaaaaaaaaaaggaaagaatgctccttctgtcttgaaacctaatttcacctggcaaatggagtttctcctcctatgtgctccctttgaacccacatgacattttatagtatttctgatgggcttcttcccaacttggactctaataatctctattcatttctctctccagttagaccgagtgccactccagggcttgctatggaaaaataaaaacgcaaaatagaacattccaggccagtacatgtagtaaagaccgtcatgatgccaaacatgacaactttggccttctccagtgtagtgatgcctgctgctctgaaaagcagcagccttatttacaagagctaaagcttggaagcaacctaagtgtccctggatggatgaacagataaacaaaatgtagtatacacatacaagggaatattagtctgcctttaaaaagaaggaacttctttttctttctttcttattttttgaagacagagtctcactctgtcacctaggctggagcgcagtggtacgatcatagctttctgcagctttcagctcccaaggtcaaccaatcctccctcctcagcctcccaagtagctgtgactatgggtgcatgcctgggtaactttaaaacaaaaagtttgtttgtttgtttgtttgtagagatgaggtgtcactatgttgctcaggctggtcttgaactcctgggttcaagcaatcctcttggctcaacctcccaaagtgctgggattacaggcatgagccaccatgcccagccaggaaggaacttctcacacaacgctgcaacatgaataaaccctgaggacattatgctaagggaaataggccagtcatcagagaacaaatgctgtatgagttcacatacatgaagtacttagaacagttacatgcatacagatagaaagcagaatgatggtttccaggggcttggggaaggggaaatggggagttactttttaacaggtgtagagtttttcttagttttacaagatgaaaagagttagtgagatggatggtatgatggctgcatattattaaattaatgctttctttttttttttttttttttttttaagacagggccttgctctgtctcccaggctggagtgcagtggtacagtctcggctcactgcagcctcaacctctcaggctccagcgatcctcccacctcagcccccccatgtagctgggattacaggcatgcaccaccacgcctggataatttttatatttttagtagtgacggggtttcgccatgttgactaggctggtcttgaattcctgggctcaagccttgacctcccaaagttctgggattacaggcctgagccaccgcggccagcctattaaggtatttaatacttctgaactgtacaatggttaattaaattaaggtatttaatacttcaatggttatgctggtaaactatattttatgtgtttttccctctcccttgtggttttcccctgcggcctcctacagggaaaagaggggaggacctatatccttcttcgatatcatctctatcctacagcttgtaggatatggtacagcttgtaggatatttttaccacaataaaaacttcttataaaaaagcattggccttgcacaaaaaggccagagttctagcctttcctggcaggaatacactgcactgggatcccttgaagccctagactagcccccacatgcaggagatttggaatatcctcactagacatcagatgaacaggggtctgtgtgacttctttaattttccatcacatatcttgtcttgccctaagtttccattcctgctgctgcctgggacagatatacaagagaaactggttttacataattttttccattgtaaatttattcttggcaaagaatcaaacattcaaattctttcacaggattatttcctttctctaggtctctttctcctttgtctcttgaaggtgacatctgagctcgtaaaacagtttgtttctgtccgtgtgctggacatcgtcctttctggcctctgctgcagaattctgagtctcaatttgaccctgagtgccctgcactggtgtccactgcagagaaactgctccttcctgatattttttgagcatgttactgatcgcccctgctgacattatagatctctgccattggctctggtcctaaggttacctcattctgtgatctcctcaccctaagccaggcctcttctgctctatcaattctctcagaaattctgagcccctctaaaaggaaggaggcagggaatcttgttaggtttttctgcaggatggctatgttggggagacaccataacatcctaatgtatgtttggggttggcaaacattggcccaaaggttgcttgtcacatgactttgtaaataaagttttattggaacagaactacacccactcagttacatattgtctatggctgcttttgcagtacagtggcagagttgatcgtggtgacaaaggttatatagcccgcaaggctgaaatatttactgtctggccctttgcagaaaaagtttgctggcctttggtctttgtggtggagtccagggttgtgcaggacatatcctatgtggctgtatgtgacagccctggctttctgtaccaggctgtagcaggtgggactcagtgaggtccctcagccatggctgtctgaccagtgccattccataccagcttggggaatgttgcaaggagtttctttttggattccagctttctgtcataccatttggggtttccaacttcaggttgagggacccagcagtatcttcatctttctttctcaaaatgtctttttttttttaatcggagtcttactctgtcacccaggctggagtgcaatggcgtgatcttggctcaatgcaacctccgcctcctaggttcaagcaattcttgtgtctcagccttccaagtagctgggactacaggcacatgccaccatgcccagctaatttttttgtatttttagtagagatgtggttttgccatgttggctaggctgttcttgaactcctgacctcaggtgatccacccgcctcagcccccaaagtgctgggattacaagtgacagccgctgtgcccagcctcaaaatttctttctcctgtggttttccccctttggactcccaccccttacccagggttggaactacttatcttctttgtaacaggtaggacctattgccttcttctatatcatctctatcctacaccttgtagaaagtctctatgctcagaactctaagggttgctttagaatttagaaatatacctttctctctcaagaaagcctggactattgtctcatgatgacattgacagcctattttggaaatcaaaaagtagacattgctccattctctttgtgtttctgctgcaactatcccaatccttcccaaagcaatagattctctgactggggagtggaggcattcatatattgcaagaacatcatcttctttgagtaattatatctggcactgtgcctggatcagagtagctgataaacaaatatgatcttgtggcagagggctacaggagagcgttagcatctagattccttgatctaatatgaaacccatccaaagagaatgagatattctgaagaatcattctttacagcaggaaacaaattctgccttagagactggaccctacattttgtgaaagggacctacgtccatgacatcatccaggtgtggccaagccgtcatggcattccagggaagctccggttacagcgacacgttctcacttttcctttatttgacattcagccactcatatggggatagctttcttcagtcaccataaccacagccagcttacacatttgtctctttgaaattaatcactctttagactgcttattctaatttctgcttcctgaaggcagagccagcaggcatctccacatggtttctccgttctccagctggaatttctgaaggacactgtgaggccacttccatttccgctgcctcctgaccctcttctacatcccagagtctaccttacatcccatgaatggacaagcagtggcgtatttctgactgcgtgggctccctgctgtcacagggcacttgctgtcaacagaaagcaggtgttctgggaagactggaggagctgtgggtggtgaggcagacactgggcttggctctggaagcccgaactcagaacattaagctgaaccatctgaagctcctccacgaaacaggttgtgcaagtctctcttcccctctctatgggttcatgcatattcataattagaacaactccaggccgaagataatgattcatgcaggaagcgccattctgaacattattatctgggagtgacaaatgaatttctaatttaacatgtgtattgcacaaatagatcacaagaactttaaagtcaaaagcatcctttggagtcatgcaacttctgttgtaatgtagcataaaatgataggggaaggaggggatctcccactggtgggctgtgcatagcggttcccttcaaagcagaggagaaataaaagggggtgagatttcagacactgtttgagtctactatagaagccaataacaatgaccaagaataaaacaacagcggcaacaacaaaaagccagtcactggcacaagcaataccattgttttgagttattatttgagaatcaacagaatcctccctatttttttctcctgctgacaacaaaaacggagggtaggccagttgggttcattggttgctcaataagaatcagagggcagtaactgcaagacaaggctgaagagggagtggtagaattgatttcagctgcatttcaataccggtttcatgttgaaatactaatttatagcatgataatatgatagcaacactgtctgcctggctgcaaagactggcctcttccagcttgtcaaagctgacagtcaagcgtaaaatggctactgtcaaggaatggcagctcttttaagactaggtcttaagccatttcttaaagttctgtatttctgtcatcactgtcccccatctcccaatcccttttctttctaaatgctagaataaactggctgcgcattctcctacctactacagcattcaccaaaagcctgtggaaaattcatactgtactagagcctggatatctacttttgatctctctcttctcttctcttctcttctcttctcttttcttctctatttcttttctttcttagctaataatgtattttaaaatgttaactaatcattttatgtaaaatcaggtgttatggtaaagcacattactttcatgacctcattaaattctcacaacaacctatgacaaaaatgctaccctgatttgctgatgataaaactgaggctctaagacataaagtgacttgcctgaattcacagagcctgtgatggcagaggcgggagtagtggaaaccagttctgcttgacttcagaggccactcctgtcattcctaaactggatatatttaatgctaaggaggcatgtctttttaagaatgtttgtacaaatattgatcgagtggaaccctggtgaaggaccttgcttggaactggacagtcaggttccctggcttcctccagctgcctcccaccctgtgggatgaggtggtgacaaagcccagaggatgtgcttgtctgggacgtagatcccttctgcaccacagtctgggacagtcaggcttgtaccctcaccactccagcccccaagaaaagcttctgcttatctcccagtagtcccatctctgaatggagcacctccccataactaaaccaatcactgagccgaggcaggggatgtggggtgctctgattggccaggtagtcacatgccccttcctggagttgtgaacgaagttaccaccatctgaatatggtagtctgagaataggagaaaggtcccggtacttgtcaggatgactaaggtgttgtgagcggaagcgggaagaaatgcccccaacacatgtccactggacttgtgaagcttccctgcctctcaactcctctgggctctgggggttgtaggagaatgtattaggaagagacacagaagggaatggaagataagagaaaaacaggccaggtgtggtggctcacacctgtaatcccagtacttttggaggccaggagtttgagaccagcctgagcaatatagtgagacccccatctctccaaaaaaaaaaaaaaaaaaaagccagatgtggtggtgcttgttgtcccagctactggagagactgaggcaggaggattatttgtcttcaggagttaaagcctaaagtgagctgtgattgtgccactgtgccctagcctggatgacagagcaagaccctgtctctaaaaaattaaaaggagggaaatacaaaagaatcctttcaggtaagtttgctcgcaaacagaaacacagaagtggagaagaatccgaaagggttcccttcaactcaagagagagaacacttaggaagaaatgctttaaaagcccagttcttggtggcaggcatctataatcccagctacccaggaggctgaagcaggagaatcgtttgaacccgggaggcagaggttgcagtgagccgagatcgcaccactgcactccagcctgggcgacagaggaagactctgtttaaaaaataaaaaaaataaaaaacagtcctgtcttattcccacatcccataccctgcagaccatacagcagtggtcttccacttttgtcctacagatacttacggctgtgggagggttcctcaggattctctgcaaagaatgaggttggggttcagaaggaagctcaatgggtagagctcacactctctcctggtttccaccagagcattctgtcattcgtcacccatttctgcatttttccgtaagaccttgttgttttgttttgttttttgttttgtttttgttttgttttgttttgtttttgaggtggagtctcactctgtcccccagggtggagtgcagtggtgtgatctccactcaatgcaacctctgcctcctgggttcaagcaattcttctgtctcagcctcccgagtagctgggattacaggtgcctgccaccatgcctgggtaatttttgtacttgtaggaaagacggggtttcaccatatgggccaggctggtctcgaaatcctgacctcaggtgatccacccaccttggcctcccaaagtgctgggattacaggcgtgagccaccgcacctgacccgttgttgtttttacaaaggccccttttctaaccattgatctacactgagacagtctcaagaataaagtcctctggttacctccacctggtgcttggtgtggtgcctgacacacagtaggcacttaataattgttgagctgtcaaatggaactgaaatgctgaatgacaaccagggaaaggtaattatgagtgaaaacttaagtcatagaaaggaaacagccttctgggcacacagagaactgatggtttccttcatgatggtatgaccatagacaaggcttgtgtacaaaggcagcctaccatttactgcatcctttttggctgccacaaagctgtaactaaacaggctcaatgtttgtgatgggccactggttaataataataacactctttgaacatttatcaagagctagatgcttgtgcattatctcatttaactctcataatggtcccatgaacggggatgttattattatgctccttttataggctggaagagattaagtaacttggccaaggtcacatacctctaatagggcaaggccagggtataaatccaccggtctgattccgaggtcccagtagttaagcactctgctacttacttaccaccagacagtgccgtaacggtggtcccgcaaaagtattttatggtttagagttcaggcaacaccagtgagaggaacactgataaactgaagtatctatcttaggaaaccagattaaagtgatggagggatggatggagaacctttgtgggagtctatttatcagggagaatgtaaagactctccaagaaaaagaagcaccttcaggtcccttggggaccatcagggaagcaagaactagatttgttttgggtagtttcaggcaaaacctagaaacatcatgttttctctaagttgacagattcccatacagtatgaaggacacactttctaacccagggcttctcaaacatgagtgtgcttatgtatcacctagagagcttgttaatgcacacacttctcaccccctactccccaaagagattctgattcagtacatctgggatggagtgtgacccattgcgcttctgataagcttctacatgctgccgttgctatgcttgggaccacactttgagtggcaatgccctagaccaggggtcaacaaactttctctgtaaagagcctgttgtagtttggatatttgtctcctcgttttgaaatgcgatccccagtgttgtaggtgggacctagtgggaggtgttttggtcataggggtccctcatgaatggcgtggtgtagtccctgcattgagtgagttctaactctattagttcatgaaagatctgattgttaaaaagagcatggcacccctcctctccctctcttgctctctgtctcaccgtatgacttgcctgttccctctttgccttcctgcatggtaaaagcttcctgaggcctcaccagaagcagaggctggtgccaggcttcttgtacagcctgcagaaccatgagctgaatacacctcttttctttataaattgcccagcctcaggtattcctttatagcaatgcaaaatggactaatacagagcctgaaagtgaatattttaggctcctggagcaactactctttcgttgtcatgcaaaagcagctatacacacaatgcaaatgaatgagcatgtgtttcaataaaactttatttacaaaaataggcagctaagcccttctgcatcagttagtgttcttagctggcagcaacagtaatcacttgctagtttaatgaggaaatgagttgcttacagcttccctttgggctaccacagagcctattaccactatcggctatgaccttgtccagtgttactgatgctttaagaagacccaagtcccaggccgggtacggtggctcatgcctgtaatcccagcacttcgcgaggttgaggcaggtggatcacctgagctcaggagttcgagaccagcctggccaacatggtgaaaccccatctgtactaaaaatacaaaaattagctgggcatagtggtggtgggcacctgtaaccccagctactcaagaggctgaggcaagagaatcgcttgaacctgggaggcagaggttgcagtgagcgagattgtgccattgtactccagccagggcaacaagagcgaaactccatctcaaaaaaaaaaaaaaaaaaaagaaaaaagaagacccaagttccatttctgccaagtcatctgctgcatcttagatctcagttggaagacagcagaagggtgtgttctgtctctgtgcctgtgtgtggctgacacacatgagcagctctcctctgaagctgaaagttgtctacgctcaagttactcacaatgggcaaagtatgatggcggggcattcccatcaagtgcattattccatccctcttgcaccatacacatcaacagaatctgccttatgcaagagctgatagacacagacagacatgcagggtgctgggagagccttgggtccaatcagtcaagtcatcaagtctgggacaaggagcatataattgaacccaactcaaggctaaactcaagttccaggaatgccagaaaatccttatccccaagaagcaagccttcatcaaattcagtttaactgttagtttgagtcatggtggcagaataacacttggttggttatgaagtcaaaaataatcccaaacgtggtctcttggataagagctggaaccctgggtcatgagggaactgatgtgtattctctttctagggaactccttgggctggtttcatctacttaaaaccataaccactggtaatctctctattctctctcatacacacacacatgtatgcttgtacacacacacacacacacacacatatagattcttactaaaggatatttgttgcagacactcagagaatctccagagaaacctggcttagaggccgtggattcagggacatcgctgaagccctgtgctggtggaattcccactactgatatcttgggccaggaactgcattctgggaaccagcactgggtatgggatgctattgcagggatctctgcctttgttatctctggaagctggacattcctactgctcctctctctgggatagattctgtgtgggaactagaggaaaagtctcacacagatatgactgaatggtggaccctaggccacacgcctctgccctctctgcaaaagcttctaggaaagaaagttttaagcttctgccacaacgtgggtaaacgcttcaaacaaaagaagggtacacagagaagcagagtgataaagagggattttacagtgcccattatacctctgaagacagctttttgggattaggttcaaggcatctagggcctttatccagtgttttttctacttttcccctctttttaaattaacctcaagtttcttccatatcctttatgttcttgagccctcaacacacacacacgcacacacacacgtcaatttctccccactaccagtccctcaggaagggcttagcttagtcataaaaatgaaacccaaattattagcaaagcaaaatctgcttctctctttcctagagagaaggaatccttcagttctcaaaaacacatggtagatagtttaaaaaaaaattgagaaagaatttgagttgaacaattcatattataatacaaagttaacttcagaccatttaataatcaaaattgcaaacaaattggtttgaattgcagcaagacagctttctggttttcaggcttgtggcaacatggaattcctttcctggaggtctttagggaattggctggatctaccaagtgggctggcataattatgtcatctttgggtgtggagatagagaagtggatcaaataaatggcgttcacatgtccctgctagccttgcttgaatactgttagtgtgtagtacccacatctaggagatggcggtgcaacgctaaacattccagcgaggacagactcacaagtgctcgcatgtctggcgggagaggcagaggtagctggaaccaggaacaaaggactgagtctggggttgggttaactactgcttattttattttatttatttgttttggtacagagtctcattctattgcccaggctggagcgcagtggtgtgatctcagctcactgcagcctccgcctcccgggttcaagtgattctcttgcctcagcctcctgaatagctgggactacaggcgctcaccaccatgcctggctaatctttgtatttttagtagagacagggtttcatcatgttggtcaggctgatctcgaactcctgaccttgtgatccgcccacctcagcctcccaaaatgctgggattacaggcgtgagccactgtgccgggccctactgcttattttatccccaatccaaccccaataagttttgcgattgctagagaccccgaaattgccagagtagttgaggagtactctaacattttctctgactcttagttaaacattggcaacttttccgagactataaatttgactggggcccagtcatttctctctttgtagtctgtgaaaattaactgagtctgcaggggctgcaatcaccgccaaaaaccgcaagtgtgggctgttcctccacactgacaaaaataacagctaattaggctgcaacaccccaaggaaagtgaacttacgccaccaatcgcaggatggcatgcaaaacgtcgccatggcaaccggcatttacagctcttcaattttaatatatcaaaggctaagggtaatttcccagcgagaatacaggagggtggatttctcccctctttattctttctgccggtcttttgccagtactgtgagtacggaagctctattcctgtggcaacaggttttaaaggaagagagccttgtgaaagcatgaaacacctggcgtgggactcctggaaatgctgggtgcctcgggaggcgcagggagaaaggcatggcattcttcttagagtctaggctgggtgaacagagctgagaggaggtgaagtgtgagctgtgaacttttgccctcaattgcaggtgaactttctgtttgcataaaaatgttttcttttctcccctctttcccctcctctgcccttccctcccctcccctctcctctctcctctcctctcccctctcctctcccctctcctctcctctcctctcctctccccgctcctcccctccacgctcctccccgctcctcccctccacgttcctcccctcccctctcctccccgctcctcccctccccgctcctcccctcccgtcccctcccctcccctcccctctcctcccatcacctcccctcccctctcctcccatcccctctcctcccatcccctcccctcccctttcctcccatcccctccccttcccctcccctcccttcccctcccctttcctcccctcccttcccctcccctttcctcccctctcttcccctcccctccactcccctcccctccccttttctcttgttggccctccctttcttcctccctcccttcttccttttttacctccctccccctttgcttttcccccccttccctccctccttccttttttccctccctccctccctgccttctggttttgttgagtgcttactctgcatcaggcacccaataggcatcgtctcatgtattcttcatcactacattgtaagataaacactattcttattttagagatgaggacattgggatgacgagtcctaatctcacagtaagttgtagagcctggatttaagccaagtcagacctcacaacccaggacccttgtagtttgtgtctcctctgtgttactaaaacttactctgtaaaaatggaggtggatatatttattaaagtcactgccatcaccatcatgagttggtcagtgctgcataacaaacacccacacaatcttagtggcatgcagtgaataagcatctactttgctgcaggataggatgactctgtgattattctgggactcaggctgaagggaaagtgcttctcacggtgatgatgttagtcactagagggtatgcccaaccacataagtgcatttcaaatctatcccatgtcatatctgctaatatcccattggccaaagcaagtcacgaagttgagcccaaagtcaagaattgggaaagcataccctcccttttgttgaagtaattgcaaatttttatagtaagggtgtgaacacaaagagaggtaaagaattggggccccagaatcattctagttcagtaactgtctatcatcatcatcatcaacttcatgatctctgtgaaccaagcttctctttacctttgtctgtgtttaaataatgagtgatctctttataaagttcttcaaagaggacagtcattcgattgaagcaaaataataattattattgagcacatactatgtcccaggcactgcactggggctacatcagtgaacaaaacatcccatctcaaaataacttactgggaaccctaaagccctgtgctagacattgagaagcccgcaagaaattctaacacatgccaaaaccattctgaatatttcacagaagatgtctgtgcatcaaaatcacctgaggaacttgttaaacaccaagactttcagaacttgccaccaacaactctaggtcatagggttaactctcaacctatcccattgaaaaccttgccccaaactacagttgagttgtaggaaaagaaagttacaggaaataaactacacgtacaccctcttctttggctactccttgggcaacaggccttgattaaagtttccagtaaatctcttccagtccccagcccccattccaacagtgttagtgaaaccaggaagttggagccacatgtgatgaggaaagacacaggtcccctcttcctgtccctctagggaacctcggagagatgtggggctccagtcatattctggttgggagttggagacaatttcgttgaattctaaattaccagactctttagtgagcgtcaggatcatcatgatgactctagaagggaggtgttacgaattctattttggcagtcaaaaatgcaaacactgagagaaggatctcactgtgatcacatagctaatgactgagtccaaatcagagtccaggtgttctaaattcttaggtttctatcctaatagcagcactgcccatgagctcggtgagctggggcttattacttaatttgaccccagtttccacattttttaaaacggggagtggtgcacatagttatcagtaatttccagagttacatatatgcaaagtgctcagcagtgtacctggcacatgtaataaatttaaccaacaaaccccagtggtagcagcatttacctgtgattttgttatcaacagataacaaaaagtaattatctctttacagttgctagagacatctcaaaatagtattaatgctcatcacttcttcaaattcacactaatttcagacacaccattagttcttgttatttagtaaattaatgagggagcacacttggcaagaaacgaaacaaggagtcttctggggggatggaaagatttcccatttctttagaagtgtgagttacagaaccatatccatttgtcaaaattgttcagttcagaactgcagactcgcatgtaaattttccctacgttgaagacaatgaaaaaagggcaaatgatgttttctgcaagtttcaggaatctataaataaattgcaaggccatgtttaaacactttttttagagcactttatagttgttcaatcatcaacagtattgatatgccaatttcaatgcttttttccatcataatctgtttattatagcagatcttctaaaggtttcttaacagttactgcactagaacactagggcaaatttgtattgtaaatgtaaattttgcatatattggagatttcaacatcttaaagaatggtaggatattgatgatcgtggaaggtgggaaatgggtgcatgggttcattatactattctatttattctttttatgttggatgttttccatgatgaatttttaaagatatttttaatgataaatttttaaaagaacctcatatattagtttatcacaacttaaaaatattgtgataactgtagttcaatataattggtttttttctgagttactatgcattttactttatgcatagtaaaaacccactttttctgagatgagatccctaggcttcaccagacaactgaagatttccttgacactaaaatatttaagatctcttctcccttttcatgctttccctgagcatgagttttcagcttgcttcagaatcacagtcttacacatttgcagagagctttacagtttacaaagtcttttcccccatcttcacgcgtcatctgcctagctgtggggacttgcagatggtacctaggactaaagatcaagtttccaaaagttgttcctttggaaaatgagggatttaccagaaatgctgataatcccagtatctgaacctaataagcaatctgtgagattaattagataagaggtggtcagttttactttgagaatgatctgaaaaataggcatttttaaaattaacaaaaacaatttctttgcatgtgctgaagatctacgtttgtaaacctcaaaatcttgaaaacacctcacttgttcagaaacaaatcaagattaaggaaaattttgaattatgaaatatattgaattatgaaatacgttatttcttttaggtccaaccagacattctaactaagctaacagaatgttgccctagaggtctagtgtagtaactttttttttttttttttttttttttttgagacggagtctcgctgtgtcgcccaggctggagtgcagtggtgcgatctcagctcactgcaagctctgcctcccgggttcatgccattctcctgcctcagcctcccaagtagctggggctacaggcccccgccaccatgcctggctaattttttgtatttttagtagagatgggatttcaccgtgttagccagccagtacagtctcgatctcctgactcatgatccacccgcctcggcctcccaaagtgttgggattacaggtgtgagccactgcgcccagcctagagcagtaactattaagaaacctttaagccaggtgcagtggctcacgcttgtaatcccagcacttagggaggccaaagtgggtggatcacttgaggtcagcagttcgagaccagccgggccaatgtggtgaaacccatctctactaaaaatacaaaaattggttgggtgttatggcccattcctgtagccccagctacttgggaggctgaggcagaggaatctcttgaacctgggaggtggaggttgcagtgagccgagatcgcgccattgcactccagcctgggcaacagagtgagactccatctcaaaaacaaacaaacaaacaaaaacaaaaacctttttttaacctgctataatgaacagatcatgatagaaaaaaaagcgttgaaattggcacgtcaatgctgttgacaattgaacaactataaagtgctctaaaaaagtttgtttaaacaatctcttgcaatttatttatatattcccgaaagttgcagaaaacattatttgcccatttttcacagtcttgtttgatatgtgtccctagcatttagtgaaacagctagtacaggtatatgctccataaatattgactacattcacgaatgaatggaaatttttggaaaggcaaatcccaattctggaatagctcagatggttcatagagtcagaatctgtgagttttccccgatttataggcagctctgcagaggggtggggcagatctggaataaacagaaaagcagcagatgaaaaggccattcttgttgcaatgacgcattggcaccatgcgattatttgttttctctaatacaatgtgaaaagtgctaatgggattagccttttgtgatgaatgctaatatgatatgaaaacaaatgctaatatgcaatgtgaaattgctaacaaaggagaaaattgctaataaaattcaatggacctcaatgacaaatgcttcatacatctccctcatctggccagggctgtctcatagcacagaaatgaaagtgaactggggagaaatgctagcctacgcgttgcttggtgagatgtggatttcagtcacttcctctgaaatgacctctgtgtgggtggggacaggagagaaggtacacgttggacacacacaaacatacacacacacacacacgagctccaagggctgaaggctccagctagaaggtatccgtacggaagctacaacatgccccatttctgtttttgtattaggcctttgaacttttccagaatgctctcctatcttttgcactgattggccttactgtaacctgtgcaattggttgggcagacacttagattctcaatcccccaaatggaaaagcagccacagagagaatggacttgcttatggccactaaaatagcagtgccagaactagattccacgtcttgggtccttcccttccctgcccaacttgccatttcatcctctccctccgtctcctcccctccattttccttactcatctccttcctctccatcactccctttcttctctttctcttcccttccccctttaccttctccaccccccatcatccacctctttcctctccctcttctcttttttctacttctcctctgtctctttgccatatccttctccatcttctctttctccaaaactgttggttcttgtcattattgtccaagggtcattggtataccagcaaaagctagtgattgtgaaaaaggactttggttggggagcagcccactttggagtgaaagttagagtaagaacctggctcagctactcacaaattctctgaagatgcataacttctctgagccttggttttcccatccgcaaaatgggttttttcaaagggtgggtgtgaatggttaatatgacaatgtgaactaaaattgtgactattcagaagtggtcatgtgtgcgggagaatactgggagggaatattgaaaagctagaaataggttattagggtgatttttttttcttcaacaatgtcctttattaatgtttcgtgatatttttatgattttcaacactttcaggcacaatgtcttcttttccttttgatatttattaaatggtttattttaaattattgtggctgggcgcggtggctcacacctgtaaatcccagcactttaggaggctgaggcgggtggatcatgaggtcaggagttcaagactagtctggccaacgtggtgaaaccccgtctctactaaaagtacaaaaaaattagctggttgcagtggcaggcacctgtaatcccaattacttgggaggctgaggcgagagaatcacttgaacttgggggaaggaggttgcagtgagccgagatggtgccactgcactccagcctgggtgacagagtgagactccatctcaaaaaaaaaataaataaaataaaataaattattgtggatcataattgaacatatttatgtggtgcatatgatattttgatacaggtaaattaatattttgtgacatctctttagtatcctgaaataaaattcatagattatataactcacagacacacataatttcataaaaatttaatgctctaatggtattataaaggaggtggaaggaaagtaatttatataaaataagtattttagtatgcaaatacttggccatgaacatagaagacatgctgaggtaggtagatgcttgtacctatattgggaatcaccataaatgggagagccacagaagcccactgatgcggatgtgttttattgataactatagtaccatatgtggctttgccagcagtggtgttgttttctgaattgatgcgcaacagctcgtcaggttctgaataacaaagtgaaatttacaattgaatcccagacctagaagtttcgttgtaaattaagaccgtgaaaaataactttgtgtttatgggaaaaattgagtttataagtaggtttttcatctacctgagtgtccagaatggcatttgaaagttaactaggatatggggcaattctgcatgggctgaggttgtcctctctaccacacggacctgaccctctaaatgcctgtagtgaccccctcctaccattttggcaacaaaaagcaacctcatacatttctaaaacgcctcctggggaggtaggatcttccctgctgagaccacagctatatttaaataataataataataataataataataataataataataataataaagcaaccaaagagaaaaccatcctctgctttgggcagtctttgacaagctctcggcttttttctctcccgcctccctctctctcgttgaggctaaaagtaaatgagaatggtggcactgatcccacatctagaaaattgaaaaagaattcatttttttttaatcatcaaacctgacagattaggcatgtctctcctgtcacatttctgtctgtcctcagagttgttgaacggaatctttccacggatccatgttattgctaataggatttgtctcagagtaagcattcagcctccccttgtttcctgagaccacagtggacactttcctcttctccctaagcccaaccttcattgtatttcagctaataaaataatttcctgccagatggtgggggaaaacatagcccctgggagaaatgatgttgctgtcatgaaagattggactggtcatgatgcatttggattaaagccagcctttccgaaggtgagattggcagttgggtttgcaacaggcagtcccatctgggcaaagtagacactccaggacatcagatctcgccggtggcaagtgggatttatttcatgcaatgggtccatgtaagtcttttcccacatcagtgttgtgtctgcttcagagttggggggattttcgtaggacttggaatttcaaagggaaaacatttggctcaagttagaatttaaggttcttcgggaaaaaaaatttctattcagtcctgtgatcccagccccagcctggaggaggcagaacccttcattccaagccattttcctgaattatattatcttctaagtttctttcaattccttatttgagactttagactaggtttcctgttctttagagtcttgaaggaaggtacagttaaggactattcctctctcctcaactttctccaaagtattgtcttgcaagagttcccatgattacttctaaccacttaaatgtttattaaaggcaatcaatcacttcaaagcaaaaatcttagatctcagtgaaatgaggttccttttgttccccatgacattctgctctatttcctctaggactcaatgttacacaaatcctgccactcatccttgaaccacaacttaatcactcatgcaaaaattaagattcgatcacttgtgtagaaattaaactgaccttttcctttacctgtaaaatagaggcaatactagcattttcccttaggagaattgtgaggattaaataagattcaggtgtacaatgctcattgcagtgcctggctaataacaagccctcagtaaactgtcgatctagcttcatgttaaacctgtgcaggaaatctcatcttcactcaactcttgggctccaagcatcctagtccaaaagttgccccagccaaaacttaggattcttctcttttgcttatgctctgtgcatctaactcattggtaagtgcagtgagctctatctaaaaaaaagtctgagtccatttctgtttcctgatctctaccaccaccaacatccactttcctcctccaccttccattatcttggctgtggcaattacatcctaattgatctttctattttgactcatggctttttaaaatccattttcttcattgcagctgagtcatcttaatttttttttaaatttaagttctgaatgtgcaggtttgtttttaatttaagtgcattatgtgcaggtttgttacataggtatatatgtgccatggtggtttgctgcacctatcaacccatcatctaagttttaagccccatatgcattaggtatttgtctcaatgttctccctcccctttccccccacccccgacaggccctggtatgtgatgttcccctccctgtgtccatgtgttctcattgttcaactcccacttatgagtgagaacatgaagtgtttggttttctgttcctgtgttagtttgctgagaatgatggtttccagcttcgtctgtgtccctgcaaaggacatgaactcattctttttatggctgcatagtattccatggtatatatgtgccacattttctttatccagtctatcattgatgggcatttgggttggtttcaagtctttgctattataaataatgctgcaatagtcatcttttaaaaattgaacttttgtcacttctttctttaaaactaccagcggctccccatgcctcttagaaataaatttagactctgtacccaaattttcatgatttcatgtgatcagatccctgcccatatctacaatctcatcttgtgcttttccttttcttcatcacgttcctgctacactgctcctctgtaagagactcatttctccctccagactttgaacttggatttgtgaacccagaattatctgagacaggtctcaatcaatttagaaagtttattttgccaaggttaaggacacactgtgacacagcctctggagatcttgatgacatgtgcccaaggtagtcaggatacgggttgtgttcatagattttagggagacatgagacatcaatcaatacatgtaagatgcacctttgttctatctggaaaggtgggacaactcgaagcagaggtttcccagtcatagatagacttaaagattttctgattggcaattggttgaaagagttattatctaaatacaaaggaatgtctggggtacaataatgggttgtggagaccaaagctgtatcatgcagatgaagcttccaggtagcaggcttctgggagaatagattgtaaatgtttcttatcagacttaaggtcggtgttgatgttaatgctggtcagcttttcctgagttccaactggcctttccattatggcctgaactagtttttcaagttaactttggattgcccttggccaagaggagggatctgttcagatggttggggggcttagaattttatttttcatttacaagttctttcagcctaggaggactttcctttggatcctcctgtggctggtttattgtcatattctgccttagcaaaattgttacctcctcaggccttctctgcccacctacctatagtctcatgtagctatagagtgacaggcatcctgctatagtcacttgtaaggtgatcatataatttattattcaacctggagcacttataaggggtaaaaggggacttttactccaattcagccaggatggtgggtttaaagcaggatagtcctggatgaattgagatgtggtcagccttcctgtttatcattcacaccttctctatatcaccatgctttattatctccatagcccttgtcgttagctgatatttttatttatgtcacaggtcaaaccccaaaattggggttcagtccagaagaccacatgggctcttggcttcacacaggaaggaattcaagagccagtagatagttaagtgaaagcaagtttattaagaaagtaaaggcacaaaaggacggctactccacaggcagagcagtgatatgggctgctcaactgagcatacttatggttatttcttgattatatgctaaacaaagggtggattattcatgagttttgtgaaaggactagggaattcctagaactgagggttcctccccttttcagactacttagggtaacttctagacatcgtcatggcatttgtaagctgtcgtagtgctggtgggagtgtcttttagcatgctaatgcattctaattcacgtataagcagtggggacgaccagaggtcacttttgtctccatcttggatttggcaagtgttggctggcttctttactgtatgctgttttatcagcagggtctttatgacctgtatcttgtgataccagtcctgctgacctcctatctcatcctgtgactaagaatgcctaacctcctgggaatgcagcccagcaggtctcattctcattttacctagcccctattcaagatggagtcactctggttagagcacctctgaaaaagcaggaaattgctggaattgagggttcctccccctttcagaccatatagggtaacttccagatgttgccggggcatttgaaaactgtcatggcgctggtgggagttttctttggtatgctaatgcattttaattactgtataatgagcagtgaggatgaccagaggtcactttcatcacatttctttctttcatcaccatcttggtattggtgggttttggccagcttctgtggtgcatcctgttttatccgcggggtccttgtgacctgtatcttgtgaaaccagtcctactgacctcctgtctcatttacatacttgttatctcttggcttaatgtaaactttaagaggaggaggatattgtctctctggttcaccattaaatcttcatcttcttgaatatgtttagcaggtggtagagattctataagtatctgtggaataaaatatgttgaatgtcaggtcctttgattgttgtaggttaggtagctatggattagttttccttgctacacctcttttgtcattttgaatggtgactcgtaaagcctgtctttctgtgctgatcaggaatcatgttcttttccagaccaggagattccaaccaaaggtagcttgtggagcaaatagggcttctctgaagtttcttacttccctttagtggcccccttgtttgaattaggtttgataagcacaaagaaggaaatagttccaggagtaagagacacttactcagcctgcatagaagacgtcatagtttcccagcagtcagggccataaaataagtggtctccctgcttatggactggaaatgccaaaaatgcaatgttgaaaataataccgcaggatcactgaattaattattgtgggtcctgattgtgtaaaatctgattattgtggagtggggattggattgcatgttaatatttaagtcctttggaaatggcactgaaggaagaaccctcccatactgtttggttcctccagcccatcccccatgagacaggatttcttgggacccgaacagaaatcaccttatcacatcagcacagattgcaggcagggcttgcacttgcactatttgcatttgtataaagaaagggcctggtattatgtaactgcatgtgggttctgagggcttctaatgggcctccttttgtacagtctcttagcaaccaattgaagtttgtaagctgaaacaaagagactggagtccatcactcctttagcacattcctctgagtctggcctgcctctaagagagccagcctagtggaggcataccttttcttccttgccaaagctcagcaatccttgttcaatcattgcttcaccttaggaaggaaaggagttgagagttggggagataggctagggactagttgtgttgtgcttagaacttcaacttagtcaagtaaagtctttaaggcaactgacctgcactcattcattcttaaaagaggcaatgttacttgacagttaagagtgttctttagggtcagaaggaatcctggctctgccactcaacagctgcatgtccttggacaaattacattatatttctgggcttcagtttcttcattttgttatgcacgaacaaaaaaatgtacccttctcattggttcactgaaagtattaaggcacgttattaatgtaaacaaatattcagggttggggttccctatgtgtccagtactgtccttggtgctgaaggcactgaagtaaatgtaacaggcaaaaattccctgctcatatatgcaaggataacactatggagggagatagaaaagctgatggtattaatgacagcatcatggaagatctcactgaaaatgtgaccactgagcaagacttgaaacacaatcccaagtgaaggccttaacatggtgcacaaaggttgtaaatgctaagtacatgttagcttttatttaatttattcactaattaatgtcgttattcatctacttatttattcatctggctaattctgaattacttactcatccacctgtccattcatccatccacccattcattctttcatctgacattacctgaaggatatgaataatattatttctatattcaacataccaagtgccataataaaggcagatgtagatgaggtttagagcaaaatttcttagcttcagcactactatcatacctggtcatatgattctttgtgtgtgtaggaggggttgtcctgtgaattataggatgttgacagcatccctagcttctgttcactagattcccatagtactcccaagccgtgacaaccaaatatgtctccaaacattgccaagtgtcccatgggtagtggggtggcggcgggggaggaattgtcttcagttgagaatcccacatttagaggaacacctttctcaggaaggaaaattaatctactgcatttctctagaaaggaaatgaatctaagactttaatttcagtagaaataatagcattttccaacattttgtttcttagaggcatattttcttgtgctgaaaagcagaagggacttggggactatttgaaattgaaaacagaatcttaccccacaggaactctttgcattgcctttgagaattgtggctcattcaaaaaacatctccaaggcttaccgaagaagtggttacaacagggaaatcttcactaacctgaaggaatgcaggctcatgcttggtgcctttggaattcttgcctgattttattgatgactccacaactacaaagctcagcccaagattcctcaatggaataacaaacagcaagactttctctctaaagaattctgttgagagcagccacgtgacttgattccttggaaaaagaaccatgccttacagggtatcatgtcgaggccagagcagccatctctgcctaagggcacctttccaggtcaatctcttccaaggacagctcctgactactaggaaggtaacttaacttgcccggtttctcactgccctgcatatatctattcctggagacatctatggtgcaagcaagttgtctggaaatcctgcagtgtcttaagcagctcttgaattttaccatttccccccattcccactgtatctcttctttcctcctctcccatcctggtcaatcaagtcccatttggtcaatcacggtagctgaataactgttcacctcattcctatggagggttgctcacttccacctgtcctctgcacagtagagttcagtcttttcactaaacacagacttcagtgccagctccgagtcctggcctgcagggtaatgcatgatctgcccttctctccaacttccacaccaaccgctctcccttcgtgctcaatctgcttttgtccccccagcctccttagctcatttacactttaagacgccaatagggttatcttatcccctcccagcaccccccaacaccagtcaaatctttgctggtagcccattgttttgtggctgagaatcctaacaaggcttccaagtccaccactgtctggttcttgtctactgtaacaccatcttccactatctcccatccctgtggtccagctgctgtgtctcctctgcccctcatgtgcacagggctcttcccacactagggcctttgctcatgtgactatctccactctagaagctcttcccttccctgcatgctgtttaagccttcaccatgtatcaaagctcagattcagcctctatttctcatgaagacttctcttacctccctgacaagttcctgtgccctgattatacattcttatagcattatattctctcattcactgcttcctagttgcaattttatatttatttacaagcttattatattatcagctctcatctatccagtttctaagcacctcaagaaatgggaccatatttgttatgttaccattttgaacttagtataaagtgcctgacacatagtaggcactgagtaaatattatatagttgggaaattgaataaatacaccccagcactcctcaactacgaagacttatgtttgcaaaattaggctaacgtgagcttttctggagccatgggggaagggttgaggatggaatagactagagaatttgtaactggggaggtatgagggcaggtcagcatcaggaaattacatcacttgacattttcttactcccttttgtgtctgtaccttcatcttatattatccaatattacaagccccttgaatgtaggcatagagccttttatttctaaaactacagtgagcacctagcccacgacctggcatatagtaggtgcttaacaaagctgcactgaatgaatagatgccacgcattctagatttaatacagaccttaccatctaagctgaggttcattcaggagggactgggaaaggaatgtgaaggctcatgattgttatttatttatttatgagatggagtttcactctgttgcccaggctggagtgcagtggcacgatcttggctcactgcaacctctgcctcccgaattcaagcaattctcctgcctcagcctccggagtagctaggattatcggcatgtaccaccatgcccggctaatttttgtatttttagtagagatggggtttcaccatgttggccaggctggtctcgaactcctgacctcaggtgattagcctgcgttggcctcccaaagtgctgggattacaggcgtgagccactgcggccgatcgttatttatttattcatttatttgagacagggtctggctctgttgcccaggctggagtgcagtggtgtgttcatatctctctgtaccttcaaacgcccggtctcaaatgatcctcccacctcagcctcccgagttgctgggagtacaagcgtgcaccaccgtgcctggctaatttttaatttttttttttttttttttttgtagagacagggtcttagtatgttgcccaggctggtctcaaattcctgacctgacctcaagtgatcctcctgccttagcctcccaaagtgttgggattacaggtgtgagccaccgtgcccagccaagatggttatttattaggaaaacatggtacattgaagtttttcacaaaacatacgacagaaagagcctggatagtttttctttttaagctaacatttatcaagaacatatttttttttttgccagccctgtgataaacgcattatatgcattatctagttaatttgtagatgctgctaaatttgcagatgaggaaactggggcttggagacattcacttatcagtctaaggccagagaatagtggcaaaattagcattcaaacttgggcctgattttaaaattcatgggcttagcaagtttgctacaaggactcttgcgctaactctgggttcataaatgagtcatccaacaccttttgccttcatgccctcacccattggatagatgaatccattcctactcacatctcaaggctaaatgaaagaacgcgtgtttgtgaacaggcatcagaatacatataactggaaggggtgccataattcatttattgtgttctggctccccaccagcctaacagggcctgttattatgtgacctcccattgcttaagcctctgataagacagtaagtctgtatacaaggtgaccatgaactgctacctgctttccaattgctgttggaagagctccttataccttacgaggctaagaagatagaagaggtatttcgctctggttttgagcaatttgttctactctgtgaacttctgtgtctgcttatccagtttcatgaaaattagattaacgagtactaattggtgctgactccgctagcttaaaatggatggtgtcaaatggaagaggagcccaccagtgtgatgtttggatcccaaagctgctgggaattaagtttctgcatggatgtcgatatcataggttacttgtggcagcttgctccaagctacttttatggaacacagtgtcacccccacagatctttgaaaggaggaaggatgctttttccaaagaggatttgcttcagatgatttggtcaaaatgctcattcattcgaggaatcttttttgagcacctattagatgccaggctctgttttggactcaggggtaccagtggtgaataaaacaggcaaagttccatccacattaagcatacattctacctaaggttggtagacaataatgaagtaaatatataatgtcaagcagcatttccatctgatacttgtatattgattaaatatgagataaacacatattttaaaaatgctttgttgagatataattcatataccatagaattcatccattgaaaatatacaaatcagtgggttttggtatattgagttgtgtaattatcaccacagtcaattttataacattttcatcactccaaaaagaaactcagcaatctttagttatcaccctcctataccccataccctacctccagtcctagacaaccacaaatctactttatatatagatttgtctattctggatagagaaaatatcatcttttgagagtgaggaggcatgggaggagactttactgtcctcacctcccagatgaggcattttggatttagttttccttggagctccctctaagatccagacttttaatcgcttcacaggctcagtttctgggggatagtaggggtgctggccagtgtcctgatacagatcctcttttttaccactttacctttcacctctaagtcctacttgagataacaggtgcagagccagtcagcaactgagagtaaatatgcatatatggaaacagaagacactccagtcagctgtgcagtcacatctccaagcaataaataagcacatcatgtttatagaagcctcactgtagtccaaattactgtaatctcttacctggactgttttagtagcctggtctccggtctccccatgtttcatcttgcctctctttcagcctgttcttcccaagataccacaataaatgtttcaaagtgtgaatctgtccatgtcactctcatgctgatgaaaatcccacatagtcctcaaggtagtcaaggctttcctttatagcccctgagggcctgcaaaacctgatccctggaagcctttccggcatcatctgtcactattcttcctccagtgtctaaatcacttttaattcctgcgaagtgtcacataatctctagccggcctttgccctctctggaacattctttcctacctgcattgcctgactagcttccatatgcccttcaggtcctagattagagatgacttcctttagtgggaggccttccttgtttcttcaggatgtggttaggtacctgtattagctttctactgctgcttaacaaatcaccccaaacttaacaccttaaaacaacaaacatttcacattttctgtgggtcaggaattcaggagtggtttagttgtatgcttctggatcaaggtctctcatgagttgtagtcatggtgttggccagagctgctgtcatctgaaagcttgactggggctggagggtctgccttgaagatggtacattcccatgggtgttggcagagggcctcagttcctcatctcgtgggcctcttcataggactatttaatgcccttacaacctgacagttgacttctcccgtgataaggtttgtgtgtccccacccaaatctcatctccaattgtagctcccataattgccacatgtcatgggagggacctagtgggaggtaattgaatcatggggacagtttcccccatactgttcttgtggcagtgaataagtctcatgagatctgatttttttttttttttttttttcctgagatgaagtctcactctgtcactcaggccatagtgcggtggcacgatctcagctcactgccacttccgcctcctaggttcaaacgattctcctgactcagtctcccaagtagctgggattacaggtgtgtgccaccacgcccagctaatttttatatttttagtagagacggggttttgccatgttggctaggctggtctcaaactcctgacctcaggtgatcagcccgcctcagcctcccaaagtgctgggattacacatatgagccaccgcgcctcgccaatctgatggttttataaaggggagttcccctgcacaagctttctcttgcctgctgccatgtaaggtgtccctttgctcttcctttgtcttctgccatgattgtgaggcctccccagccgtgtggagctgtgagtccattaaacccccttcctttataaattacccagttttgggtatgtctttattagcagtgtgagagcagactaatacaccccagaatgatcaattcaagaaagagttgggggaagctgcaatgccttgtatgccctggcctctgaagtcacacacttctatcgtaatctatttgttagaagcaattccagtcaatccatctcacatttaagggggaagaaaactatgctctacccattgaaagaaggagtttcaaagaattggtgaacattagtgacccttgtatcctgtccttacagttcctgcacttacccctaaattagctgttagcacactgagttgtcattgtctatctctttgaccatgagttcttcaaggatgaagacttacttcctttcacaatatttagaatatttctaaattctgtcacagttccttaaatactgtttagtaaccacttatttggtgaatcaatgacctgttctagatgcctgaaaggtatagatcagtgcttctcaaacattaatgggcatccctgcaaatcacccaggtgtcttgctaaaatgaggattttgattcagtaggtctggggtacagcccgagactgttttcctaacaagctccaaggggatgctgtgctccatggagcacactttgagtgggttagggtttagaagatatgatcccatttctagataagcttcataacccaactgggaagacacacttcccccagtagggcagcccaaggctggccatgaagtagtgtcagcctagtcatgggcaaacctgcagtatactggactcgctttccctccagcagccctgattgattgaagagatgtcagtgaaggacagtcaaggaagggtctgtgtgatataggaagccttccaagtaggcagcatattgtcatttggctctggaaggtagagctgggcgggggccactcatgtatatgccaaggggttgcatagcgtgagcaagggtggagggaggctgagtcaactccttgggggggatctgaaagaaagctggggttgagtggtggcaggtgatggagtccccatctacacctcagagaactcatgagcccagactgtctgctgtggttgaagcactacttttgctggaggaaaagggttagactatgaaacgtatttgtactattcctgccagttcttgagatatgtgattctaaggctcatattttagagaaaattgagcaaatccagatgttttctgttcataccctgaatctcaccttcatccttgctgttctgattttaccaaggtgaggcacgtgtgtgtgtgagtgtgtgtgtgtgtgtgtgtgtgtgagagagagagagagagagagaaatctgtcatctcaagtggggcattgtcttcttatcacatgaagggccaatgtaagcgtagggtaataataataatccccaatgtttggggaaaggtttcacatccatttagtctagtggtgctcagctgtaactgcacattggaaacccctgtgagctttaaaaattactgatgccagcagggcgcagtggctcacgcctgtaatcccagcactttgggatgccgaggcgggaggatcacctgaaagaacagcctgaccaacatggtgaaaccctgtctctacaaaaatacaaaaattagccgggcatgatggtgggtgcctgtaatcccggctactcaggaggctgagtgggaagaatcgctcaaacccaggaggcagtgagctaagatcacaccattgagctccagcctggacaacagaggaagactcagtctcaaaacaaacaacagaacacctactgatgcctgggttccacctccagagattctgatttaatgggtctagagtgtaagttgggcatcagaatgtttaaaaccttcccaggtgatgctactgtgtggccatggttgagagccactagtttaatcttagatgaacccttcactaataaaggtaagggttcatgtaagattaaactagtggttctcaacaactagataagatgacctgtctttttttatttttaaagaaatgaaaaaattgtttttcagcaagttgagtgactgcttgaaattcatacaaccaataagtaggaaggtcagaactcaaactcaagttagttggttagtgctcgttcaatttgcattaccaatgttgcctccaggtagctagtattatgcacatgacaaaggaagagaacttgaatttagatatctggttaaaggtcagactttgagttagggtgtagttagggctctatatttgtttttctgttttttgttgttgttgtttgttttttttactataaatcagtttattgtggttcaaatagataaactgacattcaaacatcttaaactttaggaacaaaagtttaacatttaaacagaagtacagttttcaggaaacatccagaaaataatttgttatctaatccagagtactgacaaagatttcttcatgataaataaagtgtgtttcaccagcagattttttttcttttttttttcattccttcataaaaatcactggcagtttgattcagaccaacttcctaatgactgtggctctgtaccttagaggaaactgctaaataaatcccttaggttaaccaatgagattggcctataattcagagggtataagcaaagcatgtaagtgaacaaattaaattgttctttagagatgatgtaaaagcatgtccattacagtaattttcgcctctgacagattattcaattttcagtgttttacttttttctgggggtgggcagggggtgatgtgggagggaagggagggtcttgctctgttcccaggctgaagtgcagtgacatgttcatggctcactgcagcctcaacctcctgggttaaatgcaatcctcttacctccgcctcctgagtagctggaattacaggcacacactaccttgcccagctaattttttaatgttttatagaggcatggtcccactatgctgcccaggctgttctcaaacacctgggctcaagcaatcctcccacctcagcctcccgaaatatgtggattacttgtgtaagccactgtgcccagccttacctgctttaaaacacaaacaaacgagcaaaaaaaaaaacccaaaaaaaaaaacacttaggttttcttggagtctgtgctagttgcatcttgcaaatgcaaaccatataatgctctttaatgaaaacctttccatgcacaccactgttaggaagagcatcattaaatcactgccttctatacccataaaaggatgattttgagtttcaagttaaatttactagagatagcttgtatatatcaatcatgtcacaaaaaaatatttccaaagtgttctctgttcataaatgtcacaaatgcttctcctatttgtcagatcattttgcaacaggttaactaatacttatctacataaaaacctgaaaattggcacaggcaagcattttgaattagtagattacccccatggaacagtattcagacttactttgtcttgtgggctctgaggctctgggaggtagaggtggaccctgacagtccaggtcatcaacatccacattcagttgaagcctctcctcaggcacagtccagtactgaataccatttatcattctgcaaaatgttgtctacatctttcaggtgctggtcattcttagattagcttcttagctgttctgttgacgaacagaagacttcaattttcaggatggatgttccagcatcttccacaagctttcactttcacatttttcactaaattatttgttataaatttgatctccttcaaaagtcccctgaagtcaactttggttgtaatgtatttgtctctaacgtattcttcaaattctctttgttttttttcctgtcattggaggagaactgcacccagaatcttatttttactacttccacgtgaatgttaaggtacacacagaggtttcatccagaagtcttccctcttctttctgttaagtacttcaatgtgctcattaagcttctctttctcttccctttccaacaaagatctagattccaagtagtgatctttttgatgagtcctctatcaaactatgacacatgtgaagaacatacctgaacaaccctcagggataatgcaggattttttgagaaagttccagggtatctcctggtgtcagtgtactttcagtcctacacctcagagttttttctttttaataacagctttattgagatacaattcataccttacatttaaaatgtatgattcagtggatttgagtatattcagagttgtgcagcctacaccacaagctaactgtaggatattttcatcaccctgaaaaggaaccctacacccattagcagttactccattctacctacagccagcctaggcaaccactaatctttctgcttattctggacatttcatatgaatggaatcatcatgtgatattttgtgactggcttttttcacttaatgttttcaaggtttatccacgtttagcatatatcaatcctttgtttctttttagtgccaaataatggctatgggcatggggtagaattgctaaatcatacagcagctgtttcatctttcaaggaactgacagtctgttttctgaagttgctacaccattttacgttcccacccgcaatttctgtacatcttcaccaacagttactattatttctctttttaactacagccattctaatgaatgtgaatctcagggtttgttttgttttttgttttttgtttttgtttttgttttttttgagacagagtctcactctgtcacccaggctgaagtgcagtggcacgatctcagctcactgcaacctccacctcctgggctcaagtgactctcctgcctcagcctcccaagtaggcgggaccacaggcatgcaccaccacaccaggctaatttttgtatttttagtagagataaggtttcaccatgttggccaggctggtcttgaactcctgacctcaagtgatccacctaccttggcctcccaaagtactgagaccacaagcgtgagccactgtgcccggcctcatagtagttttgatttacacttccctaatgattgtgtccagcatctactggccatttgttagtggttttttcttctttaaaaaactgctgagacatccataaacattttcaaaatgcagggtatgtttttcagtgttaaggcaactgttttgatgtgttttcctttgctctctatcaccaaatactgtacatacaaatagtaagactgggctttgtgttgtccactgtcaatcctaaatgaaacaaaatacatggagactttgaaaatccgtcagaataatgctatagttaagattttgctaaagcaagtgttttttctaactccttgagctgcatattgccttgagtaatcatcaaccggattgtatcctcttcggtggcagttttgtttcttctgaattcttcccttgcccagtccttcaggtatttgcaatcagaatcatttggaacttgccaaattgtttgcaaaatccttctgtagaggagaagaatttgttgccttcttatgaacgtgggcactgggcagctgaggcaccgggactcagggacatcaagcgcctgatgcatctcatgcgaccgcaccaaaacccagggctctatatttctaatgtccctgtttgctcttctcctgtttctttgaagccaagtttgggccgatacccatattagattaataaatcctaggctccttgatgacaaaggtgatattactatctgctgatccaaaccatgaatagtcaaggttgaaaaatgaaattggcaggaagaagtgtactttattggacccaaccttgcaatgtcaatgttcttagttctgagaaattcttgctcctggaattcatccagtttcatctttggatacctgcaacctccctgctcacaactcattcttgattaaattagcagatgctgatgatagaatgagactgaggccagtgatgctaaaataatttcttgctggtgaaggaggccccagaggttttacaaaaaaatttttaaaagcaccacctagggaatagagccaaaatgctcagacactgcatggaagccagggattgtattaaatccgagtaattggagtggagagggagagtgttttgtagtaattgtcatcatagctggcaccagatctcctctcaggtaagaacatagaagcttggaacttacgagagaacttagctttccagtattttttaggtgtggaatgtgaagtcatgaggggggctggtctgcgaagagtcagcaaggtgaaaagagataacagagtgtcttgggaggtgcaggagagcagacagaacaggcagggaataaagagagggagatggaaacgtgtctggaagctggaaattgcccaggcaggtggccattgagagatttctaaaacttctgagaatgggggtatgtaatattctaaatcatttgaaatcttatgcaatcctttatctgaatgccttgatggaatctgctttctacatagctctacaattgtattttgaggaataaagggaccagggtacttattagggagaggtcatacagtgcagaaaggagaaaaaaaaaaaagaacttgcagaataaaggggtgatctgtaaaatgaaccaattcagtggaaatgagacccagggttgtagctgaagttgactccccaagaccctccaaagagattggggggcaatactgtgtctcccacagtttggggtgttttgaaaaaatctcatttaaatctctgaagtcaaggtgatgccactttgtcgcaaatggagtcttcaggaagatatccagtctgcaatagcaaatgtggaggccagactaaatggaacgcccctgaggaaattatggatgtagcagcagtccagttcacacgctcattcattcattcatcaaacactggcacaacatcttacattgtcaaggcatgtaatgtgtgccgagaatatagacactgtccttgccttcaaggaactttcacctttggagtgagaaggcgaaaataactgatatttactgagctctttctgtatgcagatactaggctatctatttcacaggctttgtctttttaaaattctcccagcagctttataggtaattattatcccctatacgtgtgtgtgtgtgtatatatatatatgtgtatatatatgtgtatatatatatgtatacatatgtgtatatacatatgtgtatatatatgtgtatatacatatatgtgtgtatatatatgtatatacatatatatgtgtatatatgtatatacatatatatgtgtgtgtatatatatgtatatacatatatatgtgtgtatatatatatgtgtgtgtgtgtgtatatatatatatatatatatatatatatatatatatatatggaatctgaggcccagagagattagggaatttgtctcaaatctgacttagctaatctatgataaaaaaacaaatgtttggacacaggattatctgacccttaagttgggggaggggttcttattttggtcagaggcaattgaaaattggcagtaggtggatcagtctggatgtgtaatttggaaaatattcccggtgtttttctggagtctcacctaatctgctctgatgcctaatagcccgtccgttaccagtgctttctaacacagggttagccattgctattctcatcagctctatgtttagaagcttaacgcatcgactcagcaagccacaaacaccgtatcatggatgcgctggctagcacgagcattctgtgggcctgctaaggggacggggcagtggagagcgcagtgtggagcctggaatactgatgctccagaaacgtggagagagatgccgctcttcatggcaggtacgcaggccttgcttcctgcagcaagttaaaatcatccaccatcattagcaaagggctgttacaagggcctttttaaagtgtcctgtgcccaggctacaaggagcaatccatcatgttccataagcataaacactccacagctaattaagtgagggtgaaatcatctgcaccatccatgtgatatttatttaaaatgatttgcttaagataggcccagagtccttctccttagggaggtatagaggaactgggaggagaaaatttgggcacttgaggagcagaaacgaattggactggcaagcggagaagccacctgggcctgcagttggctgtggcagtgaatggacatctgttgtttttgtctgttcgacaccatcctctcccgccggggatccatttctcttctactcctatcatgtaatggggatggggctgccaatcacagtttaccgtccaatgccctggtcgcaggggtcagcataccatccaggttcagccaatcgtagtgccttgtttgcctgatctgagtgataggtccagagttagagccagcccttttggcagtgaggacaaaggacgttgatatttttgtgttatggagttcaaaggacaagcagcaagaacttctggggccttctttatttaccatgtggaattagctgtctgtaggagataatatcaaacaaaggccagcaaaaatggaggaagagagggctgtgagtattggggctccagtttcagttcttgagtcccctgagtgctgtcctagttcttgtaatttgcgttttaattgttgtcttctaacgtttcataacttaatacattccccttctgattacacgtctgtgaattgggttactgttacttgaaagtgaaagaaccttgactaacatagatgtgaacatcaacaatcacatcttgggaacattttcttgcatggagctggcaccttaacatgttctgtatttggtgctgggtggcaattggactgtacacttacacgtctgaacttgaatggaccccaggtatcaataggccccattctcccatttatttggcagttgagggggctgagactcatcatggaagagagactcgccatgatcacacagcaaatcagtggcacaaccaaagctgtgaagggcctgggcctcttggttctcaggccagtactccctgtcagggttagggctgatgatgtttccaggcagagcagtggaacaaatgaactaactatgaatgcacaggatcaagagtctccaaaacatgtcaggccagccatacctcctttttgccccagctctaagtttccacccttacaacttgccaacaccaggtggactgaattattcttggtttggtctcatgctcagagacccagcctagaactcaactttcagcaccttggcagcaaggcctcaaagccaaccgtacaaaaagcctagatgttttcaacatcggtgtggtgtgacttcaaagcatggtcatctacgtatcccatggagccatgaaagaggcgggctggtgggggtgggtgcacttgctgagacaaagctttctactctcacttcacccagggcacccctcctaatcacccatttttaagtctttttttttttttaaatatatatatatgtggaggtttaaggtacactgcttgaaaaagcattccccttaaagaagaaaaaaaaaactcttaaaatcacgaatttaatgaacttaaacccagtaaataagcaggaaagaaattccaactgacccttcagtaggcccagaaacctcattattgaaggtaaaaaatcacagcttactttacaatgacccatattttgacaaatactatccatcaaatgatggttttaaagacagaatcttggacaaatggccccatgcccatattgttaattaattaagatatatggtctcattcacttgtccgttcactgaatattcactgagtgcccatacgctggactcactgtgctaaatactggaggtaccacagtgaataagataactgtgatccttactcctacgcagattttagaaatttattcttcccttgcaactgaactcattttttgaggaattatctccgggcagaggaaagggaagttggctgtaagatcaggctggaaagaggttttgacaaatgaatcttgggtccatccatctgtctaaatatggagtcagtcaccatctctcctgagccaagctcaaggaggctgaagctgacacagctctccatatatttgcccctctgtgtgtctaatggggagatatctagcctattttgttctagctgctaaaatcctatctgtgtctcagtgcctgtcttcctttaaggattttgaagggtgaattagaagcatctttacaacccaggcatctaggctcccaacccctgggcatagccctcagaaaccacatatatacataatagtgagctaacctcaggggtggaggaactggtcttcccagtgacttatgaaagtctcattggaagatgggaaactttggttctagacttgaccctgatgaccatgggtagcttcaggcaaatcccttcacctgtctggctctctactttaccgactgagtgaaggaaccaaaatgtggattttcccaaagaaacatttgaatttccatttctgattggattaattaaggtaaggctagcctgctgtaattgaaagtctcaggggcataacaaaatacatatttatttcttttcatgtcatagtcaataggggtgactctggtcaagcattcttttatgtggctatgcaggggctcagttaccttccaaactgtggctctgccttcctttaaggtagaggctgtgcaaagtttccaaaaagaccacctgaataggccaagtggatgaatgtacaaaatcaaggtgattcaaaacatctgagctggcaaatagggaaagattgagagaggagagactccagtgggaggttttagggaccagggctagaggtgccatgtacctattctacctacattccattggcctgagtcagtcacatggccatggctaagagcaaggcagtctggaagatgcagtctagctgttccattggcctggtcacatggtcacagctaagagcaaggcagtctgggaaatgtagtctctgtggtaaagaggaaaggaaaacacgtttgccaaccaaccaaccagttgggtataggaaactgcaactttccatggcagtcccttcttgttattctctactcagtacgggtttaaaaatcatatacttctgcctcaaccaggaggtacttataggaggttgttgctataatccagttagaagatgacagcagtttttatgagggaaatgtgtccacacacccaggttttcccaggataggccatttatgcctgcagtctcagcatcccatccacgtggtgcttcctttaactctcaaaagtatcccagtttggatgataaattatatagtcatcctatcttcaccatgcagatgacagaagagaatatgagattgtgtaaagatgcacaatgttgctgaaaagaagccacatatagtcactgttccataaaggcagtgtttttttaattttaaaattctgcatctgaaaacacagtatgacagaaagcatctatatacacctgcagtgtttttggtatgatacagtatttaatacatccactgttttctgcaaaaaatgttgctttgtcagacagaaacaaactcccctagacaaaaaaatacagctaaggcacaattttgttgttgttgttgttctgcaaaataaaaagacagaaaaggtgcaaaaaagggcaggtaatgcagtcatttctgagactcacattctacctcaaggaaaagcattcagatgattggaactttgattactggtcaatttcagatagttcaatatctcttaaaatactcctttaaataaatagcaaaatatctacatatttcagcgtgtgccatttgaattctttttttaaaactttatttacagattttttttaaaatcaacacattacaaaatatttctgtacagttttatgcatattatgatctataacaaaatagttatttttaaaaactatatcaccacatgtctttgaaaacaatgaaggggacggtaataacttagagtgaggcctctaaaacaaatacccaaacaaatgctattgacaacataatatttaaaaaaaaaaaaggcaaaaggactacaaagacaattgcgcacaattccagtgaatttcctatgaaaaccctggggttgtctttggcctccatcagcactggagcaatggaagggtaaagaatagagtctgaaggtagggaaagggtgattcctttgagaacactacccatctgctgggaatatttagtgctatcactttccaggcaggaaggacgaagagataaatggagaacgtctcctgatttacccttgaatgaagtacatataaagtcacccagtcttgggggcaggggaggtctgcaaagccttttcaagcactctgccgataattaagccagcccattacagcagcagtatgctctgagagagtgcttcaggagttggctgagctttagatgagcacccaagccttcattttgcccataggaaaaatataagaacatttttcttaaagacgacatttgtaagcaattcctatagcatctgccaactacagattggcagccccttccttaggaggctgccacagaagcttcacgatgctgtcttctctgatgttggtggagatgggagggaaaggatggatggtcagcttcccaaaaataatgttaaggccacatttcaaaaaggagaaacctaaggcttttgttttgttttgttttgtttttgaaggagggatgggagaagcaagttggaggaacatgagggatggagtagatgacgttagggagggggatgacaaggtgcagaacccgctttctggtggtatctgtaggcagaggcagttggaatattcccagccaagtggagagggaagagaggtcactttctccctgcatacgcctggtaagaccagagccaaagacaacgtgaggggtagacacaggtggcgcaagaaagccctcctccatcttaagagggtcctatacagtatcttgtttgcaaggtaaacacaaaacaaaacaaaacaaaacaaaaaaacttctaagagagccagagaggaagagagagaggagagagagaatttgcatagatcatacattcagctcaagcagatttggacaactttgttcccccctcccaggtaaacttctcagcagacacaatgaggtagcgcctgtggtagacccatgggcaaagtaaggtaactgaggcagaagcaaacaggacatcccgtgagccagcacagctctatgtggtttccaaagaggcttccagggatgggacaagatggctgtgtcaacacttgggatttggagagagcctggctgtttcacaccctacctcctcctcctcctagactgtctttgccatttcggcctggtttgatggagtcccacaagctgtagccccaggcagatgtggacctctgcatatctaaggggcagcagtccagatctccagattctattccttcttcccttcagcacaatcttgggaccaggagagctgaatgatccatcccccctctgtggaatggtctcttgaggagtggaatgacttagcaagaggtccccattccgagttcaacatgggctgttatttttgccctgacctgatgctggcttttttcctcttctaccagggcaatgcataatctcactttaaaccacctctccagagagcagaggttgctggcagtgtacacgtggaacagtggaatttttctttgcccactatctgttaaaaaaaacaaaaacaaacaaacaaacaacccgacgttgaaaaatcagattttttccattaaatctggatttccggcttcccttccaaattggaagattccactacactgtgcttacatttttacaaacaatgacaggttggggctgagtagcagctgctcattctgggtaggtcacgtgcatgccagtaagaccacagtccccatccttgcccccaccatgcccttttgcctcacaccaaccatttcacgcatctatgctagtattctgggccccataaacatttgtaacccctaccacagtgtgtggctttgatcctgcaggtctagcttgctgtctttaaagtggagtgtgttaacagctgtttctagaatgtacacctctccacccctagatgtacccctccacctgaatgtacacctctccacccctcgatactgctgggaagctggtgctccaaatcctcagtgaacttggttgtgaaaggactctttattcacaccccactgccagtagctactgccctgctctctgcatctttttggcagaaagcttaaggttctagccagtgtcttctgtgttatctgcaaactagagaaccagagggaaacatggtcttcagacaccctacttgtgcccagagtagaagcaattgcagtgagtgagagatgggggcaggtcctgtggttctgctcatcctctctaaactccatttgcgttttagaagttaaacccacaatgagaaatgaagccggaaggactcatgatctcaccaggaaagccttttttttcccctgcaaagggagaaagcagcgcgcttctcacaacacggggaccttgggaattgctcactgcctccttggagacacactgctttacgtgtggaccgggaagtgaagtgggatgtgggaaggctggctgtctcctgagctcaatttctgcctgaatgtcactcggtgggtgggaaactataaggagtgccgcagcctaaagaatgcttccttctccacaaaccaataccccaaggcccacctgtcagccttcctgagtttccagggacctcgtcactggctcagctcacagctgcaggctgtaataggtttccagagaccacagccctatgcttttgaaatcttccacagcccaagctccaggctgtctgaccaatggcctccaacaaataaataaatcattctcaggcaggttaaaaaaattattttccctgggaaaacatcctcttttctcaaatcatgctgggctttgtttgggattttccttaaaaaaaaaaacaaaacacaaaaacacaacaaatgtaatatctgcaaccttattctctggtctattaattaataacatcagagaagggagaggaataccctgtgtgacttctcagctccccgaattagttgtggtgaggaagaaatgaagccatgggaaaaagggaagggtccccagagtcagccagctctgccatttctccacttgttccaggataaaaacaaaaaaaggcagacatgttagtgggtgcaggaggggccccatcttgaagtctgcaggttcacattatgcacagggacttgccactgctgagtccccaaagccactgcaaataacgctgcgaacacaaagcactggtggcccagcaaggagggtgaaagggaagctcccaaagtggcttcggcagccccagggaaaccctggccagaggcagaggccgggggcagaaagaggatgtggcacccagcgcgtggccaccatagagtctgtaaaagagatcataggggctttctgagaaaagtaccctgagatccctggaatcgctgttgagaatggctatctcccggactctgctgcctggatctgacgaccctcctcctaagatggatctctctcaaaggagcctgtttccctctgttaaggtcgcatgaatgcccataattagatgggccatgggaaggcaaccacggagcaagcaggaatggcccaaactctctgcagctagcacattccccacaaactctctgcagctagcacattccccactcaccctccacgttttctgcctgtcacctccttgtgcctgtgacggggggtgagtagggggaggatgggaggctcaggaattccaatactcttggaatccgagggagagtgaggctgacactctgcataaggaaaaaaacaaggctccaacggtccccaaggcaccccactcaaagccagtggaagatgcgggttggagctttctttgcgtggtgttcgatgcccctgctttactctgaggatgaggaggatggggggtagacgcagagaaagagaaaccgagagagagagagacaccagggggtgggaaaagatgggaaaaggggccttttgtgaataaaggcagcttcagttagtaaggtaacataattgacaagctgcaaaaacagcacctactaattagtcatcgactaaaacatgtaaataataaatatctaaagtgtcccttctctacgtcctccattgccaacaggacaccctgccttgcgaggcttgggatggggcaacacatctggctaggattaggacaagtcacacaaagcgaagggcagccccttcaaacccacgctggagagaagtgtcaggactggctctccatgggaagggcagatggctaccaggggtgagacctttttccaagggaatcccatcattcaggggaggtgggattacaggagcaagggaggcctcctgcgaagagctctcctggtgaacagggatgacactccagggggctcgtggcaaggaaaccttttgggtttctggtaactcaacacttaaatcatactgttttttgttgtttaaataaccttcccatttttatgttgcatgtcccgttgagcctgtggccgaagggcatgaaattaaaaaccaaatctgaaatgctatttcctggacgggaaaagtctggttcatgtggtttggtcactcccaacagcaccggtgtgcaattgacgaaggttttgtgtgtctgacctcagaacggaagggctctggcaggggatgggtgctgctgtgctgtctagctcaggagttttgctccaagcattgctttgtgagtttcatcgcgttgccttgtgagtttcatggtcatggctgtcaaagttcccattttcaaggatcaaagaaggtcatggtcttgagtctggtgctcacaaacatcatcctatttctgctactttgtgtggcagccttgagggaaggaggcccagacccctggacaggtggcagttgcacttgtggctggaccttggccatgccacatcaaaaggctttcccacttacctagttactaaggagaatagttcaacccaaggagggctgctgagaggctcagagctctcctaaggctgcagcctccatgggaaagggcccacgaccatgactttcaaggctggcaccagagtcccccagccaagagaagcagaaaaatgaaccaaagggcagggctggagtttgaacccatggttggtctgggcagtgcttgtcaaactggcatttgcagagcccttgggttctgaagaggtaccgtaggagataccctgggcaaggggaccgcccagagggctgagctttgggagggaacctcgcacttgtcagcttcaaccagagcagcttggatttcgtcagcaccctgaacctccacttatgactgtgctccgtaaacgaagttctgctgctcgaaagaaaagtctgaaaatcacacgtctggggtcaggggtgggtcactggaaggggaagacaaggaacctgtaggacttgaggatcaaccagaagaggtgagacagtcacagtgcagggactgagccatcccacccgcagcttgccaaaggcaggttgttggctgatcctgctttgacctgctgaccttccctttccatcattctatggccaggagagacccattcacagagggcctcccccagggtgggaggccggggttcaggccccacaacccctctggctgctttcccgttgagatcctgctgtggcccactcctcgtgcccagtgctacctgagccggccatcaggtttgactgcccccagctccgacttggggtcagggctgaaggagctccaggccgtctggctgcaggtctgcatgaccgggcaggctgtggggcccgtggcacagatgtccatggcagtccacatcccgcccaccaacgagtccagccatccctccagcgctgtgcccgtggaggctgcgttcctccgtgcctgttccacctgggcggggttgatgggcaggctgaggacggggtttaggctctggaagctctgctccatgtaggcattgcggaggggcccattgtgcagcttcagtgcctcctctgaaagccaaagggaacaatttcaggatcagaagagccaccaataggatgcctattcatacttaccctgtgcctggtgctgcactgggtgccatgcatcgcctcatttaattcacatgacaatctcatgaggaagttcttttagcagtcccatttcacagctgagaaaactgagcccgtaaggacagagcccactttgtacagggcacggtgcatgcctttattcattcaacacatgtttatagcgcatctttgatagtgcagacactgattcagccaatatatatttttaagcacctacattgtgccaggcattcagtcaacacatatttactaaacacccatgatctgcaaggcactgtctcatttgataaagacatattaagtacctattaggtaccaggatctattctaggtggtggagcaaaccagataggaaggttaagatccagtggagggagaacaacaacaaagaaataagtagataaataaggttatttcaggcagtgataagtgtcatgaaggcaaaaaaacagggtattgagacaagagggttggcaaactgcagtccttgggccaaatgtggcccaccacttgtgtttgtaaataaagttttattggaacatggctgtgcccatttatttgcatattgtctgtggctgcttttgtgctaccagagctgagtatttgagacagactgtattttacccaacaagctgaaaatatatctagccctttacagaaaaattttgctgactcctgggttggagagtgacagtgacctgtacccaggtctgtttgggaagtccagatctcagctgccgagcgtccaccttgtactctgcgtaagttggatttctgcttcctagaagcctaagggtgcatgaactgaccacagaacaatcactctgaaagcatgaagcttggacccgggtgaggtggggtgggaggtcaaactagctctcataacagtgctgccttgctgggcccctcctatgtgccagtcactttgtgaagcacttcatacaagagcccaggtactgcagtcatgctgtctggttttgcagccccacgtccaacataccaggtgtgtgacttctgacctccatgccttgtacctcagtttcttcatcaataaaatgggtaaagtactaatgccttccttctcactttgtgaggcttaagtgtgctgactcatataaagtatttacaaatgacacctggcatatactaagtgctgggaaaagcttagctagtgatatggtttggccgtgtccccacccaaatctcaccttgaattgtagctcccagaatccccacgtgttgtgggagggacctggtgggaagtaattgaatcatgatgagtttttgccatgttgttcttgtgatagtgaataagtaagtctcatgagatctgatggttttttaaaggggagtgtccttgcacaggcgctctggcctgccaccgtgtaagatgtgcctttgcttctcctttgccttccatcatgatggtgaggcctccctgaccattgaaactgtgagtccattaaacttcttacttttataaattacccagcctcaggtcattattagcagcatgagaacagacaaatacagctaggattattactgttggtattagtccataatcctcacacacctaaaaaactagggggctggttttatcattcctactttacagatggggaaagagaggcagctggagttagagacagatctggggttaaatccaggaccgactgactccaaaggcagtgcttatcactcaccctgatactctactgctcaaggccatcaccaaggtctgatttttcactcatgcaaaaattcaaacaattgggccaggcacgatggcttacacctgtaatcctagcgctttgtgaggctgaggcaggtggatcacctgaggtcaggagttcgagaccagcctggccaacatggtgaaaccccgtctctactaaaaatacaaaaataagccgggcgtgatggctgatgcctgtaatcccaggtactcgggagggtgaggcaggagaatcgtttgaacctgggaggcggaggtttcattgagccgagatcacaccattgcactccagcctggtcgatagagtgagacttcatctcaaaaaaaaattttaaaaattgcaacctcaggcataaatgggttaaacagtaacatgtacgtaagagtgactactactactacctcccagggctgcacgatgaggaatcaggaagtatagcaatttggggtgaaggaaagaagctaaacacttctattatttctaatagatgctatttctaatattttgaagacgttcacattcattgcttgttttattgctcagtagaagcacatatatatttttaaaaaggctggccaatgagtctggtgagttgcgctttaccaaatcaggctttgcgagagctgagatagctaggattacaagaaaccttccaagataatgcagtgttcagaagacagtgcttcctgtttgcctgacagcagctgccaccaccaaaggcacccaggacagcctggatattaacaagtgtccagagcaggcaagaagaaggaagaaagaccatatgctaacccttctaaaagcagtgagaatagtagatgaattcaaaatttgccttgactaacacagacaagatcgccactccttcaattcccaatgccccaggaagcaaaagggttgggttctgtggtttggatgggcacaagtgggaggaaggaggtgagcagtcattgagcacatactctgtctcgcaaggggtttagcaaagctgctttctcccacggtagttaggagccacagtgtttggaagtctggtcctaacccatctttctctaatacagggtagggtgggcagcttcagccccacctgccaggagaacagagcctgctgtctttggtgcgggccctaatttctctatcagagccccttagtgcctctattctgcagagtgagaaagtggagaatgaggagataccgaaactgacaaaaggcaggacattcaaagggaaaagagcagctaacaaacctgcgaacgctgggagccaaatattgtggttgatgcaaaaaaacccttatgagaaatgaggttaatgtgggaaacgctattacaatattagcttgcgatgctcgtctctataattaaattttcctcaattccacctcatcggatttcttgcgattaccagggacgcatcaatagaaaattactcttgatgaatcattttacaaattgcattgctcccacctttgtgttcactgtcattcattggaacatcgctaacaaatacaattaccaaggacaggagggctgctctcggtgggggtaaaatgactcctgggtcatcctgggcatgtgtagggagagccctgccttccttagaaaccctagaagaaaacactggaaaaatcaggaccccatgaatggcccccaggctactccactggcgtgggggtgtgttcaggagcactgcttcattctgaccaacaggtgtacctgaagcagcgaagacacagccatttactcccctctcctccatgtctggcattagacatcgttagagatggtaaagatgtgaactagatcaagaaggaacctaagacctctaagggggtgggattgggcctggtcagctctggaggggctgtcttttgcctggttcatggggaagaaggagcaggcttccagctcaagaaaacatgaggtctctgtctttctgcttgctctgcacaaagacagcagaagctgagcgtttacttcgagactcctatgatagaggattgattgattctttttttgagacggagtctcgctcttgttgccaggctggagtgcaatggcatgatctcagctcactgcaacctccacctcctgggttcaagcaattctcctgcctcagcctcccgagtagctgggatcacaggcacacgtcaccacacccggctaattttgtatttttagtagagacggggtttctccacgttggtcaggctggtcttgaactcccgagctcaggtgatccgcccacctcagcctcccaaagtgctgggattacaggcgtgagccaccgtgtctggcctatttatttattgttttggagatgatagagtctcgctctgtcacccaggctggagtgcagtggtgtgatcttggctcactgcaacctccacctcccaggttcaagcgattctcatgcctcagcctcctgagtagctgggatttcaggcacccgtcaccatgcctggctaattttttgtacttttaggagagacagggtttcaccacattggccaggctggtcttgaactcctgaccttgagtaatccgtccacctcagcctcccaaagtgctgggatttcaggcgtgagccactgcaccaggccatgatagtggtttttgtccacggttcttggctcagaactcctgtaacccttcttacagtcttttcttacaatgttgggcactttaggactcagcaaatagaatctctctctcgctctggcctcctcctgtcccccttctcctgcctaatgccagagtctaatcagattgtgggtgataggactctcattccagagagggccctgacacactccctggaggaaggaattactgcacagagaggccaaggagaatctgaacagacagggcttgctgagttaggtcagaccctttttgtccaatcacattttgacacagttgtcatgcttcagtcatgggtaaccaatgaagtcttcataaaaggcccaaaggacagggttcaaggagcttctggagagctgaatacatggtagcatcttcacaggaaggtgaggaagaactcatccacctgccgggacggtgggcaccccaatgccatggggacagactcatccacctgccaggagggtggtgcaccccaatgccatggggacagattcatccacctgctaggagggtgggcatccctatgccatggggacagactcatccacctgccgggagggtggtgcaccccaatgccatggggacagattcatccacctgttgggagggtgggcaccccaatgccatggggacagaagctcctgcactcaggactcctctggaccttgccctctgtatagcttcatttggctgtttatctgcatcctttaaaatatctttcataacaaaccaatagacataagtgtttccctgagttctgtgagctgctctagcagagtaattgagcccaaagagggggttgtgggaaccccagtttgaaaccatttggtcagaagttccaaaggcccagacttgtgattagcgggcagaagggggtggtcttatggcactgagccctcactctgtggtgtctgatgctacctctggggtggagagtgttggaactgaattgggggacacccagctggtgtctgctgcagaactgattgcttgcttgctgacggggaaaatttccccatgtattttgctgtcacagaaatcttctgtgttgatcatggcagtgtgagagcagaggaaaagtggtttgagagtttttcccaaacaactccctttgctaggactcaaggcacctcctccccatgctgtgtccccatccccttgcatcattggctaaaaggcacccaatccagaactcttcaaagctaagaggctgtaatgcatttctggcttttgagtttgtgatctgttagagatggacatgaataattccaaatatagagagacccagaaatcctgtttctacgagtttgtgttatggatgtaactgcatgggaacatacaatttttttttcttttttgtttttgttgttgttttttgagacagagtctcgctttgtcacccaggctggagtgcagtggcgtgatctcagttcactgcaagctccgcttcccgggttcacgccattctcctgcctcagcctcccgagtagctgggactacaggcacccaccaccatgcccagctaattttttgtatttttagtagagacagggtttcactgtgttagccaggatggtctcgatctcctgacatcgtgatccacccgcctcggcctcccagtgtgctgggattacaggtgtgaccaccgcacccggctgggcacatacaattttatgtttaagactcttccttgttggggctgggtgtggtgggtggctcacgcctgtaatcccagctctttgggtggccaaggtgggagggttggtttagatccaggagtttgagaccagccaggacaacacagaccacacaaccacaaaaatagttaaaaaaaaaaaaaaaaaaaaaaaaagccgggcatggtggcacactcgtgtagtttcagctacttaggaggctgaggtgagagaattacttgagcccaggagctcgaggctgcagtgagctatgattgcatgactgcactccagcctaggcaaaagagcctgacctaaattcttttttttttttttgagacagaacctcgctctgtcacccaactggagtgcagtggcatgatttcggttcactgcaacctccgcctcacaggttcaaacgattctcgtgcctcagcctcccaagtagctgggactatagacgccggccaccacactcggctaatttttgtatttttagtagatggggtttcaccatgttggccaggctggtcaggctggtctcgaactcctggtgtcaagtgatccgcctgccttggcctcccaaagtgctgggattacacgtgtaaaccatggcacccagccaacctctgttatattaaaaaaaaaaaaaaaaaaaaaaaaagacttttccttgcactattatcagtaacatcatcatcatcagcagcaacaacagaaacttatgtgtccaccaataggggaacagatagattgtggttccttaacccagtggaatatcatgtagctggtagctttatatatactgacttagaaagtaaaaaaaaaaaaaaaaaagcaatcttacagtacacaatgtattatttcatttttaaaaaatagcaaaggttttgtgatttatggtgtgtattatgtttatgctttacaagtatggaaaaacttctaaaaggattcacaccagactgttggcagtggtttctctagaggtaggatttgagcagggagaaagactttccccttaataaaaggaggtgaaaaggggcgggggaaatagaagtataaaagtaaaccctttcaatggacaaagaaaaaagtcaggcaggataggaactgacatcccagtccctgttctccatggggatggaaaccctgacctgaatttcatgttaatttcatgtttcatttcctaacagctgcctttgacatacgactcctgaaataagatattgttgactttgcctgtttttgaacttgacataaatacatcataattatgatttatctgtgatatttccccctcaacactatgttttagggactcatccaagccaacacatgcccatgctttactgctattcacggctgcatagtactccattgtatgaacagccagccaattgtttctcctttccagtgtcaggcaatcagaccgtttctggttttgtgctattaagaataattctcatgtgagcatttctgcacatgtctctagggcctataccttggggtcagacgtctgtggtagggtgtgtgtatgttcagctttactaggagatactaaaacattttctaaactcgtcttagcacttcaccctcccactagcactgcatgaatgcctattgctctcagccttagtaacacaggttcttatctgtcacgcatttcccaatatgatgggtgtgaagtggaacctctctttgctttcaattttcatttctcccatttttaatgaggctgaacatgtttttgcgtgtgtgaggggccattcatgttctctcctccatttttttcctctcttttatagcagggttggtggtctttttttttgtaaagagccagatagtatctttggctttgtgggccatgcagtctctgtcacaactattcagttctgccactgtagctctaaagcagaagcaggcaacatgtacatgaatgagcatggtgactgtgttccaataaaactttatttacaaaaacaggtagtgggctggattggccaacttctgatgaatagcatttctttataaattctgaacatgagtactttaaaaaaatgtagcaaatatcttctactattatgtggttcatcttttccacctagtgtatcatatttttgatgaacagaatttcctgttttgatttttttaaaatagtaaacaagatttgctgatccttaatacctgcctgggtttatttcccatcttgtcttcaatatgatctaggctttctggaagttgaatgggggagcgtctaacaaatagctacctaatacctagacagatgacatcatctccgtgtgcaggtaggacattagatggtttctctagggaaacacagagaaaagtattgagagcaaggagtgctgttctgtgaggccgctgcttaccctatgtctgagcagtgctgcctaccaacaccaaagaccctcaaggtccccagggaaggagtatttctcccacatagacactgggagtacttaccaggtttgatgggctgcctgttcgagaaggtcagaggcgcaacgaggaatttggtctctgcaactggcacccagtggtggagaattttcactgtccagaccccaggcctcaggggcaagttcaaagggggcttgtagtgtgtgaattcggcagtggactcaatgaggatgtcgtaggtggctgcgatgacattgacgggatccacccaaatgacggtcacggtcacattaggtcccttcccccacttctgcatacccaccggctcatccatgggccccagaagacccccaaagttgcggaatagcctctccttggcatcccagtcagtgccgacctgaaacaggggagtgaattctgaagtcactgggcctgaactagggggctaggtctcagaaaggtctaggatcccctttgttagctttcatatacccattttacagatgaagaaactgaggctccaactaagtcacctgctcaaggttgcacagcttgtaagcagaagatctggcatctggactcagtctgaaggatcaaaaggcctgtggtccttttattaaaccaccgggcctcctgtgcctggtgtatggcatgtgctttgaaaagaaaaccacacatgagctgaatgagtgaatgaatgaacgaatgaatgaatgaatgaatgcatgtcttgcttgcaggccattccacagaaacatacaccctgccactcaacaggtacagcgggtttccaattccatccttggttttctaaatcacacacctccacttggtgcaatggttctgaacaagaatagagatcatgtttttacagctgctctatcataagctagagaccctcagcattgcctgtcatctacaggggttcaaataggtttcctaggaagagacagctttggctttcccaaggcacctagatctggactgtaagcatgagagtcatcctgcgatccttccttcctgccagccagctgggggtgtgtgcagctgtgacccacagcaatcctctctggtgggcttccctccttccacttgtgccacctgcaatttcttctatatcctgtagtcagaaaggccttgtaaaatgtcctcttactgctgcccccaggcttcttagtgcactcagagtctgagctcaccccatcctccatctccatgaccccctccccatctttctccaggatgccttgttttagccacctcaatcaaggcaggctcattcccagctcagctttcctgcaccatctgccctgtgtggaatactcctttcttgcacagccagccccttatgtctaaagctgcctcacagagtctttatctgaccaccccccaccccaaatttcaaatggaccttcagtcaatctgtgtcattccctactgctttattttcttcctatcagtggtgataagcactatctcagagttgtatgttgatgtatttattctttatctcctccagctgtaatataagctctgtgtgaacaggggttttacctggctggttccctgctctttcttggtgcctactaccatgcttagtacacagcaggtgctcgagtaatgtttgttgaatgaatgggtgaatggcttgaccaaaaactgaatgaactagggagattcctgacaaggacctttgttgctatttcaaatcaaattaaattaggggtcatctaatttgaaaaaaagatctcccccaggtggattaacttagtggttttgaggacacagcatgtgggcatgttggggcaaataacgggtacagtatgaagcttgcactgcctctgctgtcttcccataattagcatctctaatgtgtgtgtgcacgaaggtcgggtgtggatacacatacccacattctgagatttcctatgtgcaggggaaataggagctgatctagcttctcattgttcttgcaagaggtactatgtcagtccattctttacccagcttacagagcttcactgctaatatttgctgagggattacagtgtgccaggcagacgtgtccattcagttgatactcccaaatccataaaggggagacccttgtcattatctttactttacagatgtggaaactgagtctcagagaagtgagataactcgctatggtcagagggggcagagccagcatgggaacccataaagtccagccccagaggctgcattctcatccactgtgctacatattgccttccattcatgaattcattcactctctcagtcattcattcacccaacacacataaaccaaatccctactgcctaccaggggtggctgccatctgtgtacactcactggcatgtgtcttgctttcagttttcatcaggccagagactaaagattaggactaagaaagcatcctgagagtaacagaggtagttactgctctgatgttcctgtgggggctgccatccctcccagacttatgaaatcttggtatttttctactaccctgtggatcagcagggaccagcaccttctgggaccctccagtgcctagcatagtgcccggaacacagtaggaattaaaaggatactatttattgaaggaataaatgaatgatcaacaggattcagttcaagcttcaaggtcttagaggtttttctaaagaaacccgatttctattttcctgcttacaacccctttcagcaactcttggtttctaagtccagttgctttacctgtcctggagacctttctggtctggctccggcttcacttctgtcatctctatccctctccctcccttccacttgctccttgctccaggccaccctgggttattcccagcacctcatccggaagggctctgtgtttcctcttgatcttctggccatgatccgcctgttctctggaccggtctacctttccccgcatcctccaggccacctcaaacttgtaatctagattttggctcaggcatcacctctactcataagtctttcctggatagaggcaccactgaggtacatatctaagcatttgatcatcatagcttttctcctgacccccacagtactgcatcttttaatttacaggtctctctctctccagatctagaccgtcaactccaagagggcagggactatatatggcatgctcaccaatatgtctctagtgtctgaaacagtgctgaacatagagtaggtgctcaatatatctctatagagatctaaaaataaagatatattgagcacctattgtctattgatcgatcaatgatctatacagattgatcatctacttatgtgtgtttatcatctatctctaccaatctgtcacattaatctgtcaactctattgtaaccattaatcatctatccatctgtttgcctattaacgtatccacccatctgtctgtctgttaatcaatctatgtatcacctgtctatcaatctatcttgaacacatattgaatgagtaggggctgaacacatggacttccctccatgcactagtttccaacagatactaacaaaacagatgaatggccacaaaactactttagggtcatatttaaggaggtgatttttcaccagttaggggaagatgggaaccctccagaacactgcccttggatcctccaaagaaatgaggataaacacttccctgaaatcgagttttaaaaccaagataacctgggcaggagagttctggagcagctgacaaacaacctggatcttgtttttcaaccgaggagcgtgaagggtgaggtgtggggcagcctgagctagggccctgctgctgtcacatcctccaagaccttctcaaggggcctcattgtggaagtccaccaccatccactgcagaatggtcaattacccaaattcaaatacatattcaaattcaagcttaacatactgctccctggcttccaaccaaccaatggctttccattgcgtttatttatttattttttgagtttataatgtgtatgtatatgtatatatttcaataggtttttggggaacaggtggtgtttgcttacatgaataagttctttagtggtgacttctgagattttggtgcacccatcacttgaacagtatacactgcaccccatgtgtagtcttttatcccctatatcccctcccctatatcccccaacccttgcccatgagtccccaaactcactgtatcattcttaagccttgatttcctcatagcttagctccctcttatgagtgagaacatacaacgtttgcttttccattcctgaattacttcatttagaataatggtctccaattccatccaggttgctgcaaataccattgtttcgttcctttttatggctgagtagtattccatggggtatatatatatatatgcgcacacacacacacacacaatttattcactgattgatgggctgcttccattttttttgcaattgtgaattgtgctgctataaacatgcgtgtgcaagaatcttttttgtataatgacttacttttctctggtagatagcccacagtggaattgctggatcaaatggtagaactacttgtagttctttaaggaatctccacattgttttccatagtggttgtcctagtttacagtcccaccaacagcataaaagcgttcccttttcaccacatccatgccaacatctgttattttttggttatggccattcttgcaggagtaaggtggtattgcattgtggttttgatttgcattttcctgatcgttagtgatgttgagcattttttcatatgttcgttggccatttgtatatcttcttttgagaacggtctattcatggccttagcccactttttgatgggattgttttttcttgctgatttgagttccttgtagattctagatattagtcctttgttggatctacagattgcaaagattttctcccactctctgggttgtctgtttactctgctgattatttcttttgccttgcagaaacttttaaaattaagtcctatctacttatctttgtttttgttgcatttgcttttgggttcttggtcattaagtctttgcctaagccagtgtctagaagggtttttccaattttatcttctagaatttgtatggtttcatgtcttagatttaagtctttgatccatcctcagttgattattgtataaggtgagagatgaggattcggttccattcttctacacgtggcttgccaattatttctgcaccatttgttgaatagggtgttcttttcccactttgtttttgtgtgccgtgttgaagatcagtaagtatttggctttatttctgggttctctattctgttccactgttctatatgcctttttttataccagtaccatgctgttctggtgactatggccttatagtatgctttaaggttgggtaatgcaatgcctccagatttgttctttttgcttagtcttgttttggctatgcaggctcttttttagttccatatgaattttaggattgctttttctagttctgtgaagaatgatggtggtattctgatgggaattgcattgaatttgtagattgcttttggcagtatggtcatggtcacaatattgattctacccatccatgagcatgacatttgcttgtgtcatctatgacttcttgcagcagtgttttgcagttttccttgtagaggtctttcacctctccttggtgggtttgggtttgttcttgtttctctagctcattaaggtgtgaccttagattgtctatttgggctctttcagactttttgatgtgggcatttaatgctatgaactttgcacttagcactggctttgctgtatcccagaagtgttgaattcaggagcaagttatttagtttccatgtatttgcatgaatttgggggttccttttggagttaatttccaattttattccactgtggtctgagagagtatgtgctgtaattttgattttcttaaaattgttgagacttgttttgtggcctatcatatggtctatcttggagaatgttccatgtgctgatgaacagcatgtatattctgcagtcgttgggtaaaatgttctgtaagtacctgttaagtccatttgttgtagggtatagcataagtccattgtttctttattgactttctgtcttgatgaactgtgccaatattactgtgttgctgtccatctcatttcttaggtctagtagtattgttttgggagccccagtgttagtgcatgtatatttagattgtggtgttttcctgttggactagtccttttatcattatataatgtccctctttgtcttttttaattgctgttgctttaaagttttgttttgtctggtaagaattgctactcctgctcacttttggtgtccatttgcatggagtatcttttttcacctttttaccttaagttcatgtgagtcctcaggtgccaggcaagtctcttgaagacagcagacacttggttggtgaattcttatccgttctgtatcttttaagtgaagcttttaggccatttacattcaacattagtattgagatgtgaggtactattctattcatcatactatttgttgcctgaataccttggtttgtttcattgtgttgttttgcaggacctgtgagatttatgctttaaagagattctattttggtttattttgaggatttgtttcaagatttacagctccttttagcagttcttgtagtgctggcttggtagtggtgaattatcttagcatttttctgaaaaaactgtatctttcatttatgaagcttagtttcactggatacacgatgcgtggctggtaactgttttgtttaaggaggctaaagacaggacccttctggcttgtagtgtttctgctgtgagaaatctgctgttaatctgatgggttttcctttataggttacctgatgcttttgcctcttaaggttatttcctttgtcttgactttagataacttgatgactatgtgcctaggcatgatctttttgcaatgaatttcccaggtgttctttgaacttcttgtatttagatgtctagatctctagcaaggctggggaagttttcctcaattattccattattcaaacttttagatttctcttcttcctcaggaacgccaattattcttaagtttggttgtttaacatactcccaaacttcgtgaaggctttgttcattttttaaaaattcttttttgtgtttgttggagtgagttaatttgaaagccttgtcttcaagttctgaagttctttcttttactcgtttgattcgattgctgagactttccagtgcattttgcaattttgtaagtgtgtccttcattttcagaagttgtgattgtgttctatttaggctatatttcactggagatttttccattcgtatcctatatctttttttttaagttggacttcacctttctctggtgcctccttaattggcttaatagtcgaacttcttaattgtttttctggtaattcagagatttcttcttgatttgaatccattgctggtgagctagtgtgatcttttggggatgttaaagcaagccaattcacaattccttggctgtcccacagtgcctgcaggggcaatccacctccttcaaaggctctatggattctcttggctttcctggcatgtttctgcagtagttcttggagcaaaagttcatgatgtggggctccatacactgctctgtccatccgagtggaagctgcaagtttgtcttgcctcctatccgccattttccctctatctttccattgcatttaaaatgcaacctgaacatctttcccgggcctgcaagactactccctgaggcctctttcctaccagtttccttctcacttgctgcacccagtacattggtctccctgcaactcgagtactcctagctcattcccagtgcctaagggcctttgtatatgctcttctctctgcttggaatgctccagatctcccgaggactggctcttttacaggctttagctttgcagtgatctccttagaaaagccttcctagatgaatcaatcattctattgaaggttgtccccatcaatgtcctgagtccccagcaatcacatgaatgaagttttctctagaatacctgtcattagctgagctgtttgtttttgtttatctatttgctcactcactggctggctgtctcattggaatgcaattccatgaccacaggggcctggtttgtttggttcaccacaatccctcctgaacctggcacactgtaggcacttggtgactacctgcagaaagaatgagcatcttttatttccaagtcaacagcatgagattcccatgtattggagaaatgtatctgagctgttcagccacctgctgtgagccaggcactgtacaaggccctgggatagtgctaacaccaaggagatcctaaatagcccacagagtggtcctgtagttcttccttgcctttctgttcatttgctactaaaattaagagtttagaaaaaattcaaaatacaagttagggctctctgcatcacatgctgttatttttgccagtgattttgatggttctcactccaagggtaccagacctgtgtagtgaggaccatcccccaaaagcactagccatggagcggccaacatcatttgtcactgccagaagtacccagtcacccaacagcaggctgataaacagggagagcccagacaccaggcattcatctctttaatgggacattaatgttgtcaattggctgctcaggcccctagcacagaatcgaactggggcagtatctaattgccccctgatgccagtaatttatggaatgggctcccttggctgctcacatccagcaaatccactgggagtcttaattgaaaacagtggcttaacaagaaactctcactggtgcctgtttgtcatggggatacatacattcgttaggcagggccacagaagctagagaaggactgtcaaggaaaatataagagggtgggactccccctctccccaacatactcttagcccctcaagatgtaccatagtctacaatcagactcttggtccctaatccagcagtcagaaccattgtgacaaatcacgtccttagcacttagggatgtgaggaaggcagaaaccaggtgctgcagttttgtgtgaataacacgcaccaggcttgatcatgcttccccttccttcctgcaccacgacccaagtacactcattcattcattcaaaagtcttactcagcatctacaaagactacatactgtctgtgtgctggggataccacagtgaagagggagacacagttccagctctcttgtgaacaatcaatgagtgaccagataaagcaacaagataattttagatagtaaatgctaagaaaaagtattaaaatagggaagggttggatggagaatgtagctattgcagcagcttaagtgggtgccggggaaggtttctctgaaggtgtatcatttggatttagatcagaatgatcaaaaacaaagctagctatgtgacccatctgtccatccatccttccttcaatccatcattcatctactcatctaatcatatattcagtgattgatctggtacttcccttgagcgaatccaggtgtgctaaaaactgtggagacaaaaccacaactaagcataggatttgtggccaaagagacctaggttgaattttgagctctcccacttcctagcaatccagaaaatctttggatctctataagcctcagttctccattcggtaaaatgggactaatattactgacattggtttaggagtcatcactggaaaaattcagaggagcagaaattctaccctaaaaaatacaactgtgttccagttggtttgatcctcccctgtttaagatgctggtgccagtgactggggccggagaaccttcttcgggcacagggttagcttatctttagggatctccaagtcctcttctcctccatctccaactagaagtgtcagatagtggagtagaatctggccgagggaaatgcaaaatacaatgaaatgtgacaagacctggcctcttacctcggaaaactgaagcctcccaaagtcactgggtgggcttgcgatcttgaagacttttttcggcatcacccaggtctccagagtctctagtttgctcacagccagattggtagcatgatgcttgatcagaaagccctggaagcggtcagcaaggaagtagaggtgcacagatgctgggtggcccattgggtagtatctgaaaacacaggcgctcatgcattagggcccaaggtgtgtaggatcacagtgaggctccccacccaccaagctagttttgttcctaaagcagtccccattgtgcacaatgcctactgttttccttgcgtcctctgtatctatgatctcaatgactatgaatacttttttcttctgctgattatgaatgaaaaacatgctgactgtaggaaagtacaacaaagaaagtgaaatgactactttccatgcctcttcccatacataatgtccattcacagatattgagtcctctggtgcttggtaccgggcagtgaaaatggtgtgtgaacactcatattgatggatttcccttcggccttatttcctatgcatctatttgcataaatactatttgcataaatactacatagttggcatctatctatcctagctattattctgtcttcattgtatagtatttcctgaggattatcacatctttgaaaagtctctgaagacacgattttgtatgtgttgatgctcggtgtgtttcatcatagttaataccagatttgatagagcaagttctctagcattggatgataactctaattttttgcttctctaaacaatgctgcattcaacatctttgagcaaaacctttcattcgtctctctctctgtttaaatgtctgaggctcttcgtgtctgcagcttaactgtttcagaagtactgatttattctctcacagtccttaccacttacactggttatcatctttaaccatgattgccaatctgagataaacacacatgcacatacatgcaaaagtggtttgttgttttaaaatgcacgtctttgatccacaaaaacttgctggctgaaaagggcagggaagtgaagcagagatgtccggagaaaagggggaagcagatggcaaaaaaggagtacctcggaggagaccagtttggtatatttcctacttgtcagataaatagctgccgcttctgcaatgtgtaaattgcacagctttataaggcgcttgtgggtccttcataatagcatttcacaaatcattgtccctgctcagctaaacgcagccttccctctggtcctgatctggagttttaagtctttatgtccaattataacagttagggaagctgccttcctgtgttcacacatctcctgaaatcattgccttgttactgggatgccttccagggagcatagaaaaaaaaaaaaaaaaaaaaaaaaacttgaacagtcttcagatggtttgttgggcattcaccgttcatgcaaacctgttttaaatctggactttgggagtggaaagtccagcgactgtgctgtcattctaccactgcagcaacatctaggcagggctatcacataaaacctcctgcgatgacagaaatattttatttatttatttttgaggcagagtctcactctgttgcccaggctggagtgcagtggcatgatcttggctcactgcaacctccgcctcctgggttcaagcgattctcctgactcagcctcctgagtagctgggattacaggcatcagccaccatgcccggctaatttttgtatttttagtagagacggggtttcaccatgttggccaggctggtctcaaactcactcctgacctcaagtgatccgcccgcctcggcctcccaaagtgctgggattacaggtgtcagccactgcgccaggccaaaagctttttatttccataggattttggggaacaggtggtgtttggttgcatgagtaagttctttagtgatgatttgtgagactttgggaaagctgtctcccaacccactagcaaagtgtgactgttcagcccttgaaatatggccaatgtgactgaggaactgaattttaaattgtatttagttttagttaatttacactgaagtagccacttgtggctaccgtattggacagcaaagatagtcatgaaagagccagtggtcacctgcattaatgtcccaaatctcccatctcctttatcttatgctttcttccatgtgactttgcaagtttccttgtacccgggaggcagaacctatttttctacctctggaatcttctttggacaacagaaagtggtagaagggctgtcacgtcagttctgagccagggcctcaagatgccttgcacatttctgtttgctttcttgctcttttgaggtcaccatgagagcatgcctgggctagcttgctggagaaggagacatttgaaacagcagagctacgccagttgtcccagctgaagccatcctaggctcaggcaactattcccagccaaggaccacagagccacctcccgacttgcagttggctgcagataggggagcaaggcctgcccatactgggaaaactgtccagctgatctgcgaacttgagcattacatgaatgcatattgtttcaaaacactgatttgggagttgtttgtttcacagtgttatcgtgacaatagacaaagcactgccagtgtgtgttctgtgaggtgggtaaagcaggagaatttgctgttacgggagtcaaaggaagagagtgtttccagaaagcagcagtccaaaaaatttagaagtcaatctttgattacttgcctcccttcaccttctttatattttttgagatggagtctctgtcacccaggctagagtgcagtgtcgtgaaactggctcactgcaacctctgcctcccgggttcaagcagttctccctgactcagcctcccgagtagctgggattacaggtgtcagccatcacacctggccccttccatcctctattctccttacacactgccagaatcccggtcaaagccaccatccttttatacctgggcctctgcaggagcttccttaattgtcaccctctcttacttttgcccactataacctgttcccatagtagccacgtccatcgtccctcacttaaatgccacaagcactttgcttcatgctttcagtaaaatccaaactccttacctggtccacaaagccctaccgctttctctagcccccttttgtttcctgctaccctaatccaccacttccttcctcattgctgcctctgacttgtcactctcacatgactttatcttcattttttgcacagcatttacccttattgatcttatattctggtttacttgtgcttaggtactgtctgtctgcacactagaatgggagggctttgagttcacaggcctggtccgcctggatcaaggctgaattctccgtgcctaacacacaggctgacacacgatagctactcaatcagtacttattgaaggagtgaaaattctagaaggattttctcttgaacctcaagttacatctacagtccctgtaaccaaggagtgagcacaaaagccctctgatgcctcatcctgactgtatttggtatctaagtaatgaaaactgttaatgtctcaaaacagaaaaataatcaagatgccgcacaaccaatcatcatctacaggaatgcaaccgaagtattcgtttggcccaaagctgtttttctttcttatttaaatacgatgagcactaaaaaaaattaggagatttggttggcaactccatctgcattcccacggaatgtactggggttcagctccatggacctccaggttcccatggtcagcccaccctgcagggggcacactgagtgattctagtgcttcgtgcctgccccggagggcatttggggacctgcaataaaatgctgacatccttatttctggatggtagattatatgcaaactttactctgattctctcaacctgccatttcagaaacttctgcaatgcatatgtgttagtttataatgagaaaaaaaaatcaataaacattatttaatgaaaggttatattatagactggaaaggcacaatttgcctaaaatacccagataaaatgagactgttaaagttttcacttgctgtttccccacatgccccggggctaggaatccattctcttctgccttttgggataagggtcttttgtcctgatttattttcaggctcctattcataaatacattggctttgcccacagcaaggcaccacagttccattacaataaaaaacgaggtggataccagaggattcctggctcgaggcaacgtgacggctcacttcattccaaaatgaatactagggagcaaccttcaacaaccctagataaattgggggtgtcttttggaatttcctgtaagatcatttaccttatacattctaggaagcctgcaactgtaattattatggaacgacatttgccttccaagtggcaggcactgcactgtctactggggatacatgcagggattctgcttccagactagcagtgggggggagagagactccctggtgaccttgagccaagataccgcacatactgaaggtgaagtccctgaactactttcagcttgggagacggtgggtgtggggtgagctatcttaataagtgtcatagaggaggtggtccttggatggctttgttgacttgagaaggggtggctgtgcagtgggaggcagtgagcaaagaaaatacagggagagaacaaggaattgttaccatcacacacagcaggttcactgttggctgcatcataatggcaactggcaactaagataccagcaatgacctgaaccctgagcagttagtacatggcaactggcaactaagataccagcaatgacctgaaccctgagcagttagtacataaaatgctgttaaaatgggaataacaaggctgggcgcaatggctcatgcctgtaatctcagcacttagggaggctgaagcgggaggattgcctgaggtcaggagttcgagaccagcctggccaacctggtgaaatcctgtctctactaaaaatacaaaaattagctgggtgtgctggtacatgcctatagtctcagctactcaggaggctgaggcagaagaatcgcttgaacctgggaggtggaggttgcagagatcacatcactgcactccagcttgggcaacagagtaagactctgtctcaaaagagcactgtataactaactcatcaggtagtttttgatgattatctcctttacacttcacaacaccttatgatacaaaaatgatgagtattactcttctcatttcacagatgaggaaaccgaagctcagagagatgaatgacttgcccaaggtcaatagcttgtaagcagagtttaaactgcaggtcctgggttcctaacccacactagtctccctttaaactaaatcagaaactttacggagagagaagccgagggatgtgaggaggtgatgggacagtgtcacagccctgcggaaaccttgctggccagggatgagacaccaggtgggaaacctgcctgtgttttcagagagttagtgaacaatcttcttccccccagccccgtcagagactgacgctaaaaaaaaaagatgctatgttgttaaatgaacaagaaaaagaaggagagtgattagaggcacttctgggaatctatcctaaggaaataatcaaaagagagaatggaaaaaaagggctttctgagaaaagatattcatcagaacattatttacaagggtacattactgacaatggcaacagtgaagggccagattaagcaaactctggaacttctgctcaatggaatactagaggcattaaaaggaatcattatcattgcggaagctactgagcagcgtggagaaatgggggctaatagtataatgccaagggaagaaaacaggatacccaattcttgttgcaattatgtaaatatccaaaatgcatattgcttcagaacaaaagaaagggtacacaacgtgaaagtcttgactggcttagggaaagagatgagaggagaagggattatgttgaattattttcctacctccccctcatcttctagaacactctttcctgaagtgttggcagttagtggtagatgagacaattgtaaggggtggttgagaagtttcaacaatagttctgcctattaattttctttgtgatatttttaggtgtgatgacattatggtgaatgtttttaaaagagttatttttcagagatacattattaaaatattgatggctgaaatgataggatgtctgggattgacttcaaactgatccgggaggaggcggaaggtgggtgaagatgaaaatgaaacaagatcagccccgagttggaaactgccggggctgggtgacgggaacatggggttccactgttctatgttgtacatctttgacattttccatcaaaaaaagttttgtaccttccacttaagacaaatgctacatatgatatggtgacaaaaagcttccttctaaagtatatatatgtagcatgaagaatgagtaaaatcattgggtacataggatatctggtatctgagaaagtaaagcacagcttggattggaaatgccacgcacgctaggagggtggcgttagatgagttttgggcaaaggaagagagaaagcatagggtggcattgcattgcagatccctaaagaggaagaaggacccccactctgtaccctgagcctcccctcctgcttctcagctctcctctctgcatcccatatagggctcaccggcagctgttctccccatccgtgtgcagggacgtctcggcccgtcgaagacccaggcgggcaaaggagtggtacaaggtgagtgtcacgtcgctcaggctgtggatgccgtcaggctcatcgtagacattctcccagtaggagcgcaggcccggggtacctgcagggtagttcccgtacaggtaatagtccagctgcccaatgatttcctgattcaccacggcttcaaacttgcgggcaaagaaggtaggccgggctgtctgctgtactcatgggattaaaaatagaaaagccacatcagcgagtgctgggggttggggggaacctaagggcatatcctgtggttagaagcaaagctctgctggacccgaattagctccgatactttttgcacctctgtgttctcagtttcaacatctgtaaaatgggttataataagggtgtgagttaatctgtgcagaacatctaaagcaatgataggcacttagtaagcatcatttcttagtaagcatcatttagatgtctgttaaataaactaaataattttagatggtaatagctgggatggatctcagacatcatttaggtacaggtcacaggctagtaatctagggcaaataaatacagcctgcagatgtattttagctagccatatttaaaacatgaaagagttcacggaaattcttttggcttctctttaaacagcaatagatctggcaaccccaggcccacactccacatggtaacaactggttaaagctgaagggtggtggctgttcctttagacagcacctaggttcttctgctcactgcagtctccaccatgccctattgcctctttggtatttcagccaacttgcagactcacaagggatcggaatctctgggactttgaaaaattcagattccaggccaggcacacacctgtagtcccagctgctcaggaggctgagacaggagaatcacttgaacctaggaggtggaggttgcagtgagccgagactgccgctgcactccagcctgggtgacagaacaagactctgtctcagagaaaaaggacctactgagtcaatagctctggagtgtagctcaaaaaaaaaaaaaaaaaattcccaggtgattatgattcagtgtttcaggaccactgatagcaaccaaactctcaaggcaacaggcccagagatggtaagggacttagctgagaacacacagcaagtcactatcagagatgggacgaagagtcagggtccagggttaaagaaatactaagcacctgtaagctaccaggtgttatactttatattcagtaaaaggccagacagtaaatatttaaaatagctttgaaaccttcagcttcgcttttatagcataaaagcagccacagacagacaagagactaaataaataggtatggctgtgttccaactaaacttcatttatagaagcaggcagtgggctgactttggcccccagggctagagtttgctgaccccttgtgtagggctgcggagacaaataaaacacaggtctctcccttgaggagcttattattgtctagtgttattattgacctaaagttgggtccagcactgttttcatggtggtagattaatagcagcaacaactactgaccacacacaatacgcagggcaatggacttatgtcattacctctaattttccctgtaacttggcaaggcaggtattatgattcccattttacagatgagaaaactgagctcagagaggcaaagcgatatgtacagactcacaccattgtaagatttgaagcccaaatgcatgactccaaaatccaagccctttctactgtatcactccaggactgaggcaactgagtaaactgggaagccccctgatcgtaagtacccttggtgttattctaaacatctcattgccagtctgcttcaggaaacctctctgtggtggggagcacagcttagcactgtagagagttagaccacctgaattcaaatcctcatttggctaccgtctagctgtgcaggtcaagttactcaaactctctgggcctcagcatccttaaaatgggttactagcatagtgtctagcacatagtgtaggctgctctttgattattatcaccagccccttgttaccaggaacccatctaggggcagaacaaactcctttctctgcctgcgattccgaccatagctggatcttctaacaaacagggcacgttaccatattattctttctctccaagttcttcgcgcaagaactctgagttccttacaggcagcagtgtcttgactctagatcttgggggatattcttaatctctgcttgctgtgaacacatgaggcactccttgtcagaggctacaatgtccccaggatgccgggctaggatacaaatgcttgtgcctgggggagtgcagggctctgggaatcagcacgtggaggttttgtgctctaagtgatgaagattctctgcgattagggcagtgagggacgggtcctctccaaacatgggaattcattgaataggtcaaacaaacattcccctgcaaccctctttcggctcagcatatcctttctgcagggaagatgtgagtttaggcagccccctgtctgccagcttaaggtggctggagctgctgtgtgggaaccttaaggggaatacgaacgacagaaaacctgcagtgtactctgcattcatacaggcacaaaaaccaggaaggcagcagggactgctggaaaaaaaccccacttggaacacccctccatgccttcgtttccttacctgaacaataaaagtgatgtctgccccagtaaagccaatgcccacacagcccggcacagaggagatcaaacacaaacaaacagcatcccgctccacatcaagggcaccttggctgggttatgagcctggcattgtgtccctgccttcctgtgttagtggtttgggaagtagcataccgtctctacacggtggctctagtgacctcagagtgattcgcttaaccattcagtggcactcatatttgtgctctctgctgctaggtgtggggagggctggaggaagaagccaccatgctggcttggagggagcagagcaggaaggggtgcccatcttggggccaagcactctcagggctcatggtaagtggatgagcattccccaccctcctgctctgcccttccccagaactgtaaattgttaggctgcccagagacagctgtaaaggggataatgttctacctcttcttactccttcaagtacacagaacacagtgttttcccacagaacacagtggtttccaaacctggctgctcctcagaaaagtgcaattcattaaaaatacaaattcgtcgatatcactgatgagggtttctcaaccagaggtgctgctaagcatcctacccatgcatgggacagcatgtcccaacagagaatcatccagccacaatggcaagagttctgaggttgaaaagctcagccctagatatatacttaaaagcatattcctgggtacaaatgtaacaaatattttgggagattctgatgaaaagggaataaagagaagatgatatgagtatggcctttggaaagttttttttaacctttctgtgcctcacagttttcatatccctaaaatggaataataatgaaaggtcatttgttgtttttgggttaatgagtcaatgtggttagaacatccctgaagtaagtgctcaataaacactggctattgttgatactgttaactattattaattatcaacagccaggtttgggcaccatgtgataagatgacctgcaggtctggccttggatttctgcagaggtttgttgggaaggcatcacttaggaggctggcagaccatgagaaagtctcacctggaagcggtggaagtcctgcggcttgaagtcattgggggagcagccgcaccagtccacgatgtgcttgtactggcacttgcagcccagcttgcgattccagttggtgatgcgcaggttgttgtccaccatggtgtcgcagtgggggctgttctccaggaccgtatggaagaaggactgcaggggagagagggacccagcctgagacctctcccagcctcccacagatgaactggggtgggaaatggtgaacccttgctctgagttcatgtaagaactggttgtttaaaagaatgtggcatctcatcagaagctgggcggcttcctgtacagcttgcagaactgcaagccaaataaacctcttttctttataaattaccaagcctcagattttccttcatagcaatgcaaaaatgtataacacaactacctgactgtcaagggactcttatgttctctgcatgcatttgaggtcagctgcccatgtggtccaactcagagcgcaggcggatgctctgtccaacagacaaatcaaagggattcaagtctgactgactgactggtgtgctggaatttcacccctggggtagggagaccagattgatggttgcattagacccagggcttcctgcatcgccagacggcaacatagggaagggagtgggtggggctgcttgctgtccatggtactgaaccaggtgccatattttctccctaatcccaggattcttggccaactgctttaagggatctgagaaagaggccatgttggatctgaaaagaaaaactagaggagaaacaatcaatcactggagtacttgagagactgccagagagtgagagaaagatttctataatagacagtcccaggcaaatatatttcctccctgttctctctccctaagggaagctgttggggaatctgtgtctgcccgttacaagttaatgggcacagccttctgatttcttctaaaccagtcctcttgaagtggtctgggagaagggagggaaggcagagatgcaggaggtgggactgaacagagaccctggagtatatgtgcttgtgtgtgctggggccagggaggggcagagaaagcacacacacggagctttggtcaccagtatcgtggtgggcgtcttgattaaaaatagccaaactcccaaacaatctcttctaaatggatgggtgggtaaatgaggctccagccgccaccccctgctgaccttcctgtgacactaaatgacaagcccatgaacctggattttaagcttgaattgcctacaagcccagggaggcatacattctccaacaagcagtgggaagatgtacccaattactgattgccctgtgtcctttcataatgatacagaaattccctgcaatataatggatgaggaggttatcagaattgagagaagaggtgattgatttttgctgaaataggattaaaagctgattacttaacatgtgtgcagaatagtaaaacctggcccagtgatgacaagctcatcatccctctgggtgatgggggcagtcagccctccccggagcttggcactgccccagacacaggtgagagatgtgctgggagtgtggcctgcagaaacacacataacctatgtggtcccgggaaggaacaagggaccgttcatgagaaatgccatagactcaatagaaacggaaccagctctgcactgttctcaagctggattggaaatgagggtgcaatcaacctggaggtcaggaagatgaatctggaatccctcaacccagctctgaccggcaggcagctaagggaatgtcagtgacaatccttcagaactggatcccctccccacttctagatggggctaggactgttttagaatactctggattaatggagtatgacttatgaaaccaacacccttttcttcagggaataatagagcaatgttcaacatgagaaaaggcatgcttggtgtaaaaaggtggtcattacatgattggtcattgtgaaggatgcgtcaaaagttgatgtggcggccgggcatggtggctcatgcctgcaatcccagcactttgagaggctgaggcaggaggaccacttgaggccaggagttcaagaccagcctggccaacatggcaaaaccccatctctactaaaaatacaaaaattagctgggtgtggtggtgggcgcctataatcccagctactcaggaggctgaggcagcagaattgcttgaactctggaggtagaggttgcagtgagcagagactgtgccactgcagtccagcctggatgacagaggaagactgtctcaaaaaaaaaaaaaaaaaaaaaaaaaaaaaaaaagttgatgtgggtgtgtcctgaaagggtcagcatatacagttgtgcaggttacacactacataccttttaggggtgccatcagcattgtggatgtcagaagggttttttaaataacagttttctggaaaatagccataaggttcttgttctaacaaaatctgtgtatcatgtgatttttatgaccaatgaaagccaagtatcttgaggaagagctgccttttctattttgcacaaagacactgtgtggactgccggtggtagcaccgtgtgtctactccacgcagcctctgtgcagactggagggagaccaggcatcctgctaagacagcaaggatgtctgggtgtgtagaggacaatgtaggtggacccagaatctctttgccaaaaattcagcatctgctttgccacaaaggctagaacaagcccctatctttcttgggaaaattttcccagatactcacctcagcaggaagcagggtgtaggagtagaactgtttcatcttggtcaccagatcgtctgtggagaaggtcacatattctacaaacctccggttcagcaggaaccagtccgaaccgccatccacggcaatgccctctgggatccgccgatctcccaggcgccacatgtgagcgtcgcactccaggaagagccgatccaggccctgcttccgaatgaacctgggagggagaaagctgcccttagcccagaggtgtcctgaaagacagaactccagccagagtccaaataaaacaacacaatcatagcgatgatggcaattattgagtgcctgctgtgtgccaggtactgctccagggctctgcgtggagtttatcacttgatccccacaagtgaggcatgtcaccgtatttacccctatgacgcaggtactatttgacccccaactttcatatgagggcactgaggcttagagagcccaggggacttacccagcacagtcagatgacagtgatcatctgctacagctactccttctctagagaactttggcaacaacctccttatgccatagaggtcttggcagtttagtgaatgcagaccatggacccttgtctcagaatagtactcttcaatgcatacaacaaaatatacagggttatgaaacagcgaaaaataaaaatccaccaaagttctgatataaagtaatgcctgtgcttcttgactcacacattatatacaggattacaacatttttaaaatttttattttttgagacagggtcgtgttccgttgcctaggctggagagcactagtgtgatcctagctccccgcagcctcaaactcctgggctcctgtgaccctcctgcctccagctcctgagtagctaggactacaggcatgcatcaccatgtttggctgatttttaaaattatttttgtagagatgggatcttactatgttgcctagactggtcttgaacttctggcttcaggctcccaaagcactgggattacaggcatgcaccgccatgtctggctgctgcttaaatttttttgtagagacagggtctcacgatgttgcttaggctggcgtaaaactcctggcctcaagcaatcctcccaccttggcctctcaaagtgctgggattataggtgtgagctactgcatggggcctggattacaaaatacattttaaaacactgaatgtatggtactacgtgtgtttctttattaatacattaaataacaagatatcatggcaggtctattaaatcctgtaattttttttttttttttttttgagacagggtctcactcggtagctcaggctggagtgcagtggcatgatcttggctcacagtaacctccgcttcctgggttcaagtgattctcctgcctcagcctcctgagtagctgggattacaggcacacaccacctcacccagctaattttttttttttttgtatttttagtagagatggggtttcaccatgttggccaggctggccttgaactcctgacctcaggtgatccacccaccttggcctcacagagtgctggggttataggtgtaagccattgcgcctggcctaactcctgaaattttgaagtagtggtgagcataaatgatatttagaggtatctgcaccaactataatgtgacaggaaaatagatgattcctactggtgaccgagtcagttagttactgctaatactactgtgatttgttacctacctttagctagatttcagttagaattccattaaaaaagatatcattttcttctcatccaaaatcacgaacctcccctgaatttttcccatgaaccctagattaataactcctactgtagtaactatatacatataatcatcttgtttagaattttgcaaggcaggctgggcagagttggcatttcctattttgtagatgcagaaaccaaagctgttcaggtcccagagctggtgacgtgggcatgttgggagggtggacagagctagaaccaaggcttttgggccaaacgctcagtccattagcaattagcattcattgcacacataaccatcattgccattaccatcatcaccattttcattatcatcactgtcactgccaccatcatcatcatctccatcttcattatcagcaccactatcaccattttcacgtattacgtgccaggtactgtgctggcccatggtacaggtcaaggagaagtaaggacgagctctgctcctaaggagctagttatctagatgggagcttacagtctagagttgaactcagggacctttctgctccttcaggctgctggcccttacacacgaccaggactctggatttttcaagcccttatgaataactctattgtatgaatgcttctccacaccaccacagtttccctacacatgtgcctttggtcatggactccgtatgtgctgggaatgattgtcttcttcctctccccttcagtgttccctgagtgaacttcacttcatcgatcagattgcagaccaaaagctactctctcagtccttacagtcttacaacactgtaatttcttccaccatcattgccattaccatcatcacaatttccattatcaccactgtcatcaccaccatcgtcatcatcaccatcatcatcacaatttccattatcaccactgtcatcaccaccatcgtcatcatcaccatcatcatcacaatttccattatcaccactgtcatcaccaccatcgtcatcatcaccatcatcgtcaccaatttcagtatcaccaccatcttcatccccattatcactaccaccatcaccatggcaatgaaaacatatgagcattatcattacaagggctttatatggattatctactttaattctcatgaaaaccccagagacagtacttttattaacccatatttacaggtgtatgaactcagcaacttgccatagcacatttctgtgattctgtgattactgtctaccctttccagtagactacaagcttcatgtgagctagggttgttcttgtttttgctcatcactctgtgcctggcacacagtaagtgcttagcgagtattcacagaatggatagatactgaatccatcaataggcaaatacatgtccagcacctaccacaaccccagccttgtggtgggtacagtgaaagacaggaaacactataaacgacaggctttatcttctaggaactcatagtctgactgggcaaatatgatacaggcacatataaccataggttaaatgagtttcgaggaacttctggaaaaatggggactagggcaagggtgaaaagccagcatgctgtggacttggttggtggtcagggatggcgtcatggatgaggcagggcttgagtcagactaggaggggtgcagggaggagagaaaaatggacattctagacagaaaacagactcatcagagatctggggagcagaccagtttggcttaattgggagattgctctgggcagatgacacagattgaaaaggtcatacatttttaataaagataacatccacacaatgtaaaataacaagagaccaagaaatgattttatgatgaaggggatctaagtgtctcgaggaagagctgccttttctattttccacaaaggcgctgtgtggattgctacaggcagcaccgagtgcctactccatgcaggctccatgcagactggagggggatcaggggctctgctgtaacagcagtggtttaaaattaagcatttaaggtgtacagtttagtggaattagttcattaacaatgttgtccaactgtcacctctgcctggcttcaaaacatttcatcagcccccaaaagaaaaccccatacacattacacagccactccccattcatgctagcccctgataaccatcagtctgtcttctgcctctatggatttaccaattctagatatttcatataaaggcagtcatacaatatatggccttttgtgtctgcatcttttgcttcgcataatgttttccaggttcatccatgctgcagcaggtatcggtgctccatgccttgtttttgcctgctcagcatccatttatgatttttctgggaaccacattttgctttactttggactcatccttaaatctcagtttacttgggtctgtatcctcaccctagcaccagggggtgggaacatgacccaggatggatcagagcatcccatctgtctggcctccataatcaattcagggatgggccagcaatgcaagctgggtctgagactaggtcttggattgttgctggagttagtgagaaggaggggcttttctatgagatttctggcagggaggatgtcagcctagggctgctggtagccatctcatcaccatgaatatagaggttgtctgacaatggagcaaactggaaataggagacagaaagacacagtgccaagcgcttgatgggttcacttgagattctggatctcactgtgcctgaccctctcccagacttgtgtgttatgtgcttaaggcatttttgagatgagattcctcacttgcatttgaaaaagtcctaatacatgcctgaatgatttcaacttaatcacaaccatgatgtgtggggaggttcttaggctccagacagggcaggtagccagggctgtggcacaaaaatgcttcctcttccactgagccagtctgctcagagttctagagctgtctgcatttctgcaacagacctcgttactctgtcttcagactggagttacctgtctcctcgcaggtagcctttattctcactacaacacactttggctctggactttgtgcctcccttccaggtcctaggacagtgcaggtcagctgctcaagaaaagtctactgtgatgaggagacttcagggtttggaagctgaagatggtcctgccctggtagtcacgctgaattccagaaagaattccctctcaccgggcttcccacaaatccactgacattcactcaggggaattacttgaaacctcattagtaaacctacattcttagcatttcttttctgcatgagcagaaaacccacctctagacattggctactatggaagataatgacatagtacacctaagtcatcacaaaatggatgatggtgtaatgaaatggcgatgacggtaacgctggcagggaacagacttaattcggctgaaatgtgcttttcatctgtggggcagtgtggttttacctgtcaccagctgggtgacttcaaaatgttaaggagtcctctctgagtctcagtttctttcttggtaaaatacaaagttggtctagatatgggttgtaaagttagatccctacagggcggtcagacagataatggaagcgtgtgaagcagcctgaatacgaaaaaacaaggactgatgaaattagcagagaagtgaagaacacacattctgaaatgcacttccactcctttaaaataaaaaagcatttctggttgaataaaacatctctctaggatgaatccagcccataagccatcggtccagtcacaataatcctgggttaggtaattcccaaggtactctccagctttgacattctataagtcacattgttatactcaggaaaagggcatggggcaagcaatacatctcatatggatacacgggagcccagagaagactggcaacttttctaaggacacacagaggactcaacacaagggtagaaccaatcaaaagacccagctgtcctatgtcacgggtcttgctctttctctaacacatctttccacatgcaaaatctgagctcattagcaaagccatgttcttgctacagagcagtcctctctgtgtctcagtttcccccttggtaaaatacaaaattgggctaggtctgggttgtgaagttaaatccctataggggtcagacagacaatggaagacagataatccaagctcattagcaaagtcatgttcttgctgggaaggaactcagcgaagattttttgtaatacagtattaacccactgaaatgtaactgagctctaactgggtcatcaaaggaagcccctgagtttaggaaaataaaaccctgccttgactctggctagtgctaattatacaaaaatgtccagtcgatgcacttaaccatgcttgaaactttcaattttagataatttgtattcaaacttacatggttaccagactaaccatgagagacagacagagaagaaatacaggtgagaggactagcaaaatttttctttccagtttttaatttcatgttccattatatgggataatagcatcgtcttgcaattttaatgtgatgtcccggaccataatattcaaatacaatatttatgcagtcatctccaaaatgaaatattcatgggattgggagatgggttgctgtatttatcacattcaaaaactgatatgctgcaaacgcatgctttggttaactaagagtaaatggagacaaccaattccctaggtctcagaaaagtttctggagtcacaggggtgaatggggacttaagtcttggactaggagatggtggcagaggcccagcaacagggtatctaccaggggagaggcatcagctgtttgggcagggatttgcattttttcttccctttctttaccataacttgaaaaggtaaaattggaaggcaaggtaagtcagtgaacacctgagtgactttttataaaatatggctcaccaacaaggggcgcatggctctctcacctgaggcgtgaagcacagatctgtagcaataagccccatatacaaaaggtgaccaatgatacgctcttccttttcatttcccattgagtaggttacctggggcaactggggcaacaggtgacactacagcaaacagacattgggtgatctaggtactaatcctgcctctgcattcacaggctatgagatgtggggctggcttaacctctctgaatgccagtttcctcatctgtaagataagccccatgacacctgtgtcttgacagcctcctgaatcagctgcaaagtgtgatggatgatgcttctcacagggccttgcaaagtgtttagtaagcgctgttcacccaagcaatgaaccgactcaaccatcaatcccttcttacctaaggatgacatccctcccccatgcctggcatcctcaatcctcctttcatgctttgtatttctccacaggacttttcactttctaacacaatatacaagatatttatttagtctgttgtctatttccactcactagatgtaagctgcaagatggcagagatttttgcctatttttgttcactgctgtatccctactgcttacatcagtgcctaccatacaactggtgcttaataaatatttactgaaaaaatgaataaaaagaagggtaacagccacacctgttgggcaatcaggcagtcacagactttcgttaactaggtattggatccttctaacacacatttaacagaaaagaaaattgaagctcagaaaagttatgtaactttcccaaggtcacacagccagaagtcttgaatttaaatgcaggtctagctggatccaatgcaagctcttaactactctgccatctttgatgccctgattcaccatagtcccaccaaaaagatagaaagaacggatctgtgatcttctaatgcttgaaaaagacaatgcccagaaatgagagagaatcaaaagagaagggcttattgttggctttggaagaatctttctgccagacctctggaagatatctgtcttctacctgaggtcaaatatgaaatcatttgcattcagttttacttcctaggctatgaggaaggggcagctcaccttcctgatatttttacctattagcacactaaggaaaaagtcacagctaaatatgatcctattgggacatcccagggaccaaatctactcagctgagcatcaaagtaaatcagacagagggtgggaagaagtcctgattctcccccatgggagaagaagtcagttaaaaaaacatctgtggcttttggaaataatgtcagaaaggtggataacaaagaagtttctcaattcagttaattcactggctacaatcttggtatattcatcaagtatggaattattccagaattaagctgtcccactgtaagttttagaaggaataactctgctcttcaagtttacagcatgtctgagcaagaaggaatcttcacaagcagctaatatagctaatgctacaaattaaaaaaaaaacaacctgagaatgaaagtacaaatgatacatccaaagtcacaatgcctagaaaaaataaaatctcccccttttctgttttcctgtctggtaatctgtcattgaatctagattactccttcagcataagtacaacctaaggattttagttaaaaaataaagtcatggaataaatcatatagacccacaatgcatgaaatcagtcagctatgtgaacaggctcacacatctcttcctaggctctcaggaaagggcagtttagctgcctgagatttttctctactggcacaaagtcacagctaaatattattctattgggatgcagtggcaagattttgagtcctggaatcagattacttggcccaagtcttgtgtcttctactaaccttaggcaactttaatcatatggtactttggtttctcacaggggaaatggtgatcataatagctaattcacagagctggtgtgatgattcaaatgagattgtatacagggagggcttagcacatagtaagggctccataatgtccattacgatgctttatgtttttttcctttatcagggtgaatttctatctgtcctattctctcttctgggatttggtagacaggtacataggacacctccacagctaagaagaaatcctttagtctggcagagcaatgatatttcagcaccaaggacagaagtccttgttttagttgtgcaatagccatgattgtggcatgaaggtgacaagtgtcctggccatccttctaattctgtccaagctctggatgagctcgcgaggattcagctccctgattttgaagtttggcagttcctcagggcccctgctagccatttctctcaggcccacggtaggctgtgccccttctgggcctgagctggagtcaattgttattcctctatcctacagtagctggaagatcaagaatgcttgaggaattcattcctttagcagcactagagagcaccttcgatattccaggctctgctctatgcactgagaaaatggttttaaataaaatggacatcaccccgcccttctctctcttctaggcaagacaaaaagcgtaaataataacagctaccatttattgagcgtatactacattctaggctctgttctatgcacttaatatatattcttctgtttagaattcactgcaaccccatgagggctcattttacaaatgaaggaacagagacacagaaaggttaagtaaatttcccaagacccacacagctggtgagtggcaatgaggggaatcaagccttagtgtcaggctctgcattccacactctagccacaaggttctaataagtaagtagacatcgagaaatatgaaacacaaatataaaattacatgctatataggaacaaatatgggggtaatgatagaaaataaagagacagggacttaattagtggagatcattggggaaggcttcactgaggagcaggtggcatgcaagctcaaagagaaggaatcagtcctctaaggagttatggggaaggcctttatgagtgacagaaaattgaaagtgcaagggccctgtggctgccaaaggaagctacagggaagtcctcagcttcagaacctcacttcataggggccgacttgatctgattggtggaagggacataccacccacaagtccacgtggcttggatatggagggaaactccgcagtcagcacccttagggagtcagtgcagcatggtggttaagcaccctgacttcaggctgggcgtggtggctcacgcctgtaatcccagcactttgggaggccgaggcaggcggatcacttgagctcaagagtttgagaccagcctggacaacatggcgaaaccccatctctactgaaactacaaaaattagctaggcatggtggcacatgcctgtaatcccagctacctgggagactgagacacgagaatcgcttgtaccttgcaggtggaggttggagtgagctgagattgcactccagcctgggtgatggagcgagactctgtctcaaaaagaaaaataaaaagaaccccaactttggagtcactctgcttggcttcaagtctgtctcgccacctatgagctgtgtgttatttaatctttctagcctcagtgtccccatctggaaaatgggcacgatgatgatcgcatttatgtcatggggttgttgtagaaagagtgaatatctgtaaggtgcttaggataatcagtggcacatgtaccagttattattgctgccctgtgtggagaaagctgacttaggtttgacattcaaggatgatgattagttcaatgtcagaaaaggggagctagggaggcagctcagatgccatcccggcctccaataggagaatgctgcctctggcagatggggttcaggccagagaagagagagaaacttctctataccacttctgacctggggctggaatctacctgcctggctttcttatatttcccaaggagggcagaaaaagaagctcaagtagaaatgcagagtcagtggcctgaatcctgaggctggagtacctgggcttggtggctcacattcttcacagggctcacgtcactgaatcagcttgcatcgccaagcgtctaaaggtctgttgagggctaattggttttccacatttcatgtatttttgaaaacattgtttactgccttttttctgattataaaaggaatgcatagccttgatagatggtttggaacataaaaaaatgcaaagaagaaaataaaaatcatactctacctttcagagatgacactgggaatgtacttcccctctagtcttttgtctaacttctttgtgtattgtttggaaagaagaaaagttctaaagatgacctaaaaacacacgctgaggcccagggaggtatgtgtgtgcagttttgtgtgggtgcctacataatgccagactttattttgacgtggctgctataattggattaaataaagtgaacatgcaaacagtcatgaacgcatcggttgggtttaaggaaagcaaaagagaaatgcaatctgctttccctattggagatgagatattaatgatctccttgcatcagtcatggagctacaagttagccagaaacagagctcttctctcaataagcaagctggcaccaaaggccttcccgaatgcggatttgcctggaggaggttcctggccaggctctcgactgatttgccaacttttgtttaaacatttgcttgtttatacatcaaaggaggtttgggtctgatgattagttcaatgtcagaaaaggggagctagggaggcagctcagatgccatcccggcctccaataggagaatgctgcctctggcagatggggttcagaccagagaagagagagaaacttctctataccacttctgacctggggctggaatctacctgcctggctttcttatatttgaaatgatagctgtttctcttactatgctttgccttactttaagcataatacccataaatcatgggttggagtggctaattttataaattgttgtcgatacatataaggtcaatacctaactttcatcacatgcccacttataaagggcccaaaagaatctcccatgtccccagtggacatgagagttattgaacataagagttattgaacatttttgtaacatcttaattatgtgtatattatcatcaagattcttctcatatcaacaacaccatcattatcaccactactaccaccaccattgtgatcatcatcaacttaataggcgcaactaactgtccccaagggcttttccatatattaattcttgcaacaactctatgggattggtatgattatcctcattcccatcttacagatgagaaaactgatacacaggtaactcacgtaacttacccaaggtcacacactgtgagtgggtattagagttggcccgtgaatcttgacagtctggctccagagcctggattcttaactgctatgctatgtgctttatgtagcatcctatacaagaggccccttaatattctgctctaagccaactttattatttttagagacatgatctcgctttgtcacccaggctgcaatgcagtggtgcaagcctcaaactcctggccttaagcgatcctcctacatcagcctcccaggatgctgggattacaggtgtgagccactgtgcccggcctctaagctaactttaaatagcttcaactgttttctttcaatgtagccttattcgaagcataatatccataagtcatggttggagcagctaattttataaatttgttgatacacataagatcaatacctaactttcatagcatgcccacttataaaggacccaaaagaatcccccatgtcctggtggcacataaacacactttgcaaaatgctgaccctaggaagtaggggaaggacctaccctcacccatgcaaaaagataattctatttacattcagcaggattttctttcatctgcacacctcgagagcgtaaacctgcaggtcctctcaaatgcagtcactatggagtaataaaagaacacaggccttaaagtcagacggaaccaggttccatctcagctctgtcgttcactagctgtagggccttgagtaaggtaaagcgactctcaaacctcagctgtattcatttctgaaatggggtaacacctgctaaatgaaggtgaaatgagaaaatgtcctggaatgcgcccagcgtggggccttcctgtggccagtgaggatgctccatctccccaataccatgatcattatttgaattttataaagatggagaaacagaggcatggcctgtcgaagccatttgctgacatcccatggctgtggtatagaagagctggcatttcgacccaggtggctggactccagcatctatgctctggcacttcacacactgtgtcccagggctaacatgggggccctggtgaccctggatgaagtggagaaattagatcaaccagggaaggaaaagtctcagaaaaactccgattttcactttccagctccctggaagaggcctgtccccacacactgagacttgaacaggtttcagagatttgaaaaacttctctgatgctccctgagccaaggccagggacttgtagggatgtttccaaatacctgattattcaggctgagagtaaacatgcggccacctgcttctgcaagccctgctgaggctgcctgggaaaatgacaattgtgctacctgtcttgcaatgtatctagtgactttacttttggaggaaagcaaggagaaacagtgaacacaaccctccccttcatttaataacagaaacaatcaggaccaatttggcagctattagaatactagtttgcctttatgccatctcttcacagtgggagccagaagtccaaattggctgctaaaggttggagatgaagacagaaggtcaacattgctattaggagctacgtggaattaaaaaccgaggcaccccgtggcctattctgtatttcactgcttgcctttgttcatccccatctctctgtctttcaagatctctgcctctgtcacctcctcttttaccagggctggtctggacacatgaaataccagaatgggaagggaatttggagactttctcatgcaacccccttgtttttcaaagggagaaaatgaagtcaagagaagcagagtagctgcctcaaagtcaccagtgcattggaagaaagcaggcctagaacacagagaggcttcatcacgtgagaattatgagcttggactctgtgaacactcacttgggtgtgagtcctccccgctgccctagtgctgtgagtttgagcaagtaacttcatctttttgagtctcagttcccttatctataaaaggaggctaatatattgccaataatccccacccagtgccagaaaattaaacatacacacagaaaaacagaactaatagagagtctgggcctgatgatataatttgcacagcttgatttagccatacctgaagtcagccctaatgttttagttacctgatctggtaatgttctttacccttaagctagtttgagctgggtttctgtcatttcccaccaaaagagttctccctaacacatcaccagtgaaagaacttgagcaagccacgcccagctctggtcacttgggagggaccatggatgatgggctataggtaggcttattcgtgcagcaggtgaggccacagctaacaaagagggaagtggccagtgaatgggacattggcttgttttactattaaattaatgctgaatcactgccctaacttccggtaaatgagaaaatcccagctggggactcacacgcaagagttggaagttgtgagctattctgtcaagaggcctttgggttttagggtcttggagggaggtgtaagaagcatttcctcagcctgagacttctttatgttgtcccaagacatctgggtaccacctgtcaattacggatgcacatcaattatacaaaatgtactcaggcacctagaggcaaaattcaggcccattctccatctatttctttctcctaccagcaacaatttagttctatgcttatcataacaatgacataatcatcaccatcaccatcatcataaacatttactatgccaaatgctgtatatgcagcatctcatttaatcttctcaatgaataaatgagtataggtctattaatattttcaaatattatgaaaccagttcagagaggttaagtcactcgtccaatgcaacacagctagaacacagtagatcagaattccaaaccagaaggtgtaacctcacagtccctgtttttaacttgtgctatactcagttcctagcacagtgcctgacaaatagtgctcagagaataaatcctgactaggctgaaatagttaatactagggtggatgtaattcacacacaagttgatacatttacaatgggctcctttctcgagacacaactttgcacaaatcacctattagctgctacctggagaagaagaagggtttttccttctctacctgagggcgaggaataccaatgtctgagccacttctgacaattaaccacctccatggaatccttgcccagccccactttgctcctgcagctatggggccagaaaaacttgggttcaaattctagcatttaaccagctgtgtgatcttcagaaaaatcaggtaaactccagaagcttgacaaatggggagaataattcttacagctgcattgagtggctgtgaaaacaaatatggatcctatacaaaaagggcccacttagtaggaacacaatacacagtggccatgattcttcttactcatccagccaggcctctgtactcttagtggcctgagcgtagtaaactaatctgtgctaatttacagagcatcttcaagttcgggtgttgcagaaagaggcctcctttttaatgtaaagaaggtaggctgtgagtaggggcaggaacaatccataaatagcagaatgaaatcaaagtttcaatttagaaaaatgatacaacacaaggattctagggttacttttttttttttttctattttgagatggagtctccctctgtcacccaggctggagtgcagtggtacaatctccactcactgcaacctccgactcccaggatcaagcgattctcctgcctcagcctcccaagtagctgggattataggtgtgcaccaccacacccggctaatttttgtatttttagtagaaatggggttttaccatgttggccaggctggcctcgaactccagacctcaggtgatccgcctgcctcaccctcccaaagttctgggattacaggccttgagtcacggcacctggccagattacttctttaaagctcaggagacggagctacctgcttgcttttgttcctcccatgctgtggataactgggtaaactgtcacagagccagccaaaatgacactcccaccaacaacagcagtgaagatttaaagcagagattacaaacagagatgtggtcgggggccaggttggggaacggggacaggcaaggaccgagcgacctaagatccaggaaataactgccatgagaaaattcaggcacagacttaatggaccttcagattttttaagactggctagaaatctggattttcataggaaatactgctgtttttaaatggggctattaattttcaaatgaagcacctgaatgaaaacaagacaaaacaaaacactctgagagctaaaccatgcacgttaacaagctgaaatgatcccaagcactgccaggttcaatgctagaacaagaccccgggatgtcagagccaccctggactggtgtttaatggtgttttctttttttgttttcttttttagatggagtctcactctcttgcccagggtggagtgcagtggtgcaatcttggttcattgcaacctccgcctcccaggttcaagtgattctcctgtctcagcctcctgagtagctggaattacaggcatgtgccaccacacctggctaatttttgtatttttagtagagacagggttttaccatgttggtcaggctggtctcaaactcctgacctcatgatctgcccgcctcggcctcccaaagtgctgggattacaggcatgagccactgcgcctggcctttaatggtattttctattggaatgaggaatcccatcacgtgatgtcacctacagggggcgctcaatactgtatcccttccagttgatggaccatcatggagacttgggctcagctcaatgctgaactgcagagatgctatttttttgacattgttcattttaagcgagagaggtgtgagggatctgggttggggttctgggtgcctcccacccctgctgatgtgttggacaccagtgagggagtgaggaggacatggggctgggatcaggacccctgggttcaagtccatgctggtatgacactcttttccactacaggtcaattccctgagaggaaggacttggtcttgtttgcggctagaacagcaactggcacacgcccatgcttgttaagtatttgaatgagtggctgactgaatgaacgatctggggacgttgcttacattatgggcctcagtcttcccatcaataaaatgagaattaaccgtgggtgccctactgaaagggttgctgcaatgagatattggacttgtggaagtccttgggggaagtaatcaaaagggctgtcacaccatgagaaacatctatggttatcttgtccttggctgacagaagggactacttcagatcccacgcagacacagcgaaggacagctggtgccaagcctttctcccaccctcaacctttctgtggctgcatgaaaccagcctagaaaattccccaaatgatcactcagattttcatttccattttgtacaggggtaggggttgaggtgctaccttgcattgtcccggccgtgtgacttcaagaaattcatatctcggtatcgggagagaaacgccaccaactggtcatttgtcctgtggaaacaaaccaaggggagagtcaggccagacaccgtgggtactgtctttgtcacagaaagcaagtttcaccaattatgtcagtctgcttgaagcaccttctctgatcatttgcacacaggctgataaggcatcctctttatatcgccatttttatgtcaccatcactgactctatcacactatgttaaaatgggctgtttgtgcatttctctcctctatactccaatatactggagactctgtgagggcaagtgtggtgctccacatgtttgggaatctccagtgcctggcactgggcttggcaaacagcaagtcagcccaaagctaaatgcacagcaacctcaggacctttgcatttgcttgcctgggaaatttctcccagtattgctggcttggctttgtcatcaggtgtcctttcaaataccacctctttagagagaccttttctgaccacttaacctaaagtagtacctgcctcccgctctctccccacctttattacatcactctgtttataatacttcactcttgtatcaccagctgaaagcactgaccttgcttacattagaatgtaagttccacgaggacagagcccagctggatttgttcaacactggcatacagtaggagctatattaatatttgttgaataaacaaatgaatcaaagtgatgtgtgttcaaactgactccttcaaatgcactttgagcaatgaatgcatcaatgaatggacggataccaagtcctcgataaccacggggctactgattgagagagctttaaaaaatatgaagtccaatacaaacgagtgacatcgttgccagcattgttatcccaaatttatccccatcaatctcagcactagcagtgtaatcacagctaatccgcttgcgcatacagctgtgacagtattttaaaaggcagtcacacgggtctccatctgccagaaacgcagtcgcctcttctgctgaataaacccaaacaggtaaatggtgctgatgtgacagctcctttatcaccagccttctctgcttcggaatttttacttcaaaggaaagcgttaactattgtttcaaatgggaggaacagagaagagagcagaaagataaaaaaacatctctggggttataatagaagctagaccttcgagaagcaggacagtgctttagaaagcaatgcttgggcagaaacagaaagatctggggacagatcccagctccatgactgagtcagctgtgtgtccaaggatgtcatttaacctcactgaatggcagctttctctgaatgcgcctaggttgaaaattaaacatgcccagcacctagtaggcccatcatgcatatatactgaatggacaactgggtggatttaaagggcacacagtaggggcacaatcaatgcacgtcgtcctgctctgcctcccaactctttggtctgagctgcccctactgctcaccccctccttcatttccctgcgcctctgcagtctcgccactccaagcccctgttctctcattggatgactcatgttgaccaactcataattccagcggagggggcacaaagcagttaagagaggcagcagtgaaaatgagcgctgctcgtgtcccatcctattactgaaataaacaccaattcaaaaccagccattctagcagcggcaggcaccagaaacaccccgtgtgtctgcagggagttgaatacagcacacacacggaaagctaaaccttgctgatgggcacagaggtgaacccaggggatgctcgcaaagggctaaccccacgtgtccctacaatggtgcatctcccgcgtggttaaaccccatcgtgcatgccaaggtaaagtccactggtgcctccgacactgttacctgtagtttgtggggacagagcctctttaataagtcgctgggagaggtggaaactaaatcggcctataaaaaaatttaagcaatgtttctctccaaaccataaagaggcccattccaactgcgttttaacagctcttatttaccaaccccctcaccactctccgcaacagttcattattgttgtcctgatgaatacgagacaagttaacctctgaatgggtccccggcagttggaataataaataaggtctctcagacacccttagtgggaggattgaaggggccgggccggggctcctgggcccccttctcgtgaagcctcaggtctcccagggtcagcggctgcagttccatttggcaatcccagaaagcgcctttcagggctgtgagctggggccattttcacatttaccgcttcaccgagtccccatctgacggggatgaataggcatttagcgaatttacttagcgatgcttccacatgaaatcgtctcaaaagatgacatcttgggggagggagggtggatgaggagggggctgaggtttccaggcccagagcttttgggcaaagccgcctttcaaagccaagcgctgtgtgcttggcaaaggatcctgatggattgtctggaagggtggggcggggggacccctgcctaccccccttgctagggtctcgggcccctcgctctccctctgtgtgaaatgcttgctctgaatgctaaagcccatccccccagtccttctccaaagggagatggaatttggctgaggaccaaattctcctattgttgctttcagacgcctgtcgataattgcctacataatatttagttctctccagataattaacagcttgcgatctggtgacattttaccccgttccagtttctcgcgcgctctctctctctctctctctcttccactcacacacgtttctcactctctttttctggtgaagtcatttgccaaatggttcccatagttcatctcttgtatctatctcatcatcaatttcctcctactttttgctgaaatgattagaaatcatgtctcttggtctatgccagttcctctgcttcctgaggataactggggcctgttgctaccaccatgggagtcactgggaagtctctgctgaaataagtaagaaataaatgttaaaataaacttactgggagccatatgagaatctttttcgaaatgaataaaaaaatgagtaatacaataatctcccaagtcccagccatttactaaatgtgcaccatgccctaggccatggggaaagacttttgccacattttattgcatttgatagtcacaatgatgctaaaaaatgtaaattttggctgggtgtggtagctcatgcctgtaattccagcacttggggaggccgaggcaggtgggtcacttgaggtcaggagtttgagaccagcccggccaacatgatgaaaccctgtctctactaaaaatacaaacaaattagccaggtgtgggcatgtacacctgtagtcccagctactcaggaggctgaggctggagaattgcttgaacttgggaagtggaggttgcagtgaacacagatcgctccactccactccagcctgggtgaaagagtgagactctgtctcaaaaaaaaaaaaaaggaatttcacttcactctcattttacggacgggcaaccgagacttagataaatcatccatttagtaaagtgcagaaccagaactggaacctggggacaaatgtcacagcttgtgttctctactacgagactgcctctacaaatgatagtgaatgaacgagtgaatgaatgaatgaatgtattccatttcaagtgcagaagaaaaaaaatacaggcgcaataatgtcttcctcttcatagcctggtctgcagcccactgctattagaaatgccatacttcaggccccacccaatacctattgagcaacagagctcacccaatatctattgagcaaaaatgtgttttcaaacaagattccagatgatgcatgtgctctttaaaatttcagaagcattgctgtaagtcatgtatgactatgagtagttaattctctgctttccatctttatctgctcctcatggtttcttctggagaacccggactatgaatgaattactttcatttcaataagccttaggtcttgagagtattaaataaaaacaatgcacctaatatctgtgccacagtacttggcatatagtaatcccctgataaatgtcagctattatataatagcattattattaccatcttgaacatcagaagcttaagacaccttgaactgtggaaaacagtgtaaagacccaacctgatttgaacttggaaggctttctgtgcataagacccatggaatgttctgcagagcatagtttaagagatgtccaaggccccttcctggggatttgtccaaggtcccttcccagctggtgtcagacttagggactggctcccagagggccatggcaccattgtgtgtgtgtcttatctatataacagctctggacatgaagatatgaaggaagagagggcagagttctcaggttcccatagcacccaggagcccaggctgtatggaaaaggtgccctgggcacacagaggcacacaatgcctgtttgctggtggcatgtgacaagagatgaagcctgctcagcttccactaggaaggagcccaacacaaagccaactgcacctctctgggctcccggtgcccacctggcactcatgccccagaaccccttcccgactgcaggatactgtcaaggaccctgccagaggtgctcacagcccaacggtgaggtgacaggactaaagccaaagttatacgcaggattttgtgaatgtcaggattcaggatttcaaacctctgatgctgccaggtgtgcacagagcccaggggacactggagtaagtcctcctggactgcaatgaacgacccattgtggggcagaaacacacatgaaagactatggggaggccaggcatgcctgtaatcccagcactgtgggaggccaaggcgggtggatcatttgaggtcaggagttagagaccagcctgaccaacatggtgaaaccccgtctctactaaaaatacaaaaattagccaggtgtggtggcatgcgcctgtgatcccaggctgaggcaggagaatcgcttgaacccaggaggtggaggttgcagtgaggagagatcgcgccactgtactcccacctggaaaacaagagcgaaactctgtctcaaaaaaaaaaaaaaaaaaaaaaaaaaaaaaagaaagactatgctggtgcatgagggactgtgaagtcaggcaagttgaggaagttgagggttgaggtgctttcaacctaagctgagaatagactacaacagtgtttccccaacttctgcttctagtgtacccataatctttaagttatttcatatgtctatttaatttaaattctactttagctttatcttatgcaccaatgtttgtgatatttgatgtcacaaatttttttttttttttggagacagagtcttgccatcttaaccatttttctgagatcagacgaggttgggtgtgttcagggtgatatgtctgtagaccatcttaaccatttttcagtgtacagttcagtggtactggatggattcacattgttgtgcaaccatcaccaatatccatctccagaactcttttcatcttgcaaaactgacactctctacctgttaaataataattctctatttctctcttctatagcccctggcaacccccattctacttcctctctgctattttaactattctaggtacctgacataagtggaattgtacaggatttgtgttttgctggctgacttatttaactagcaccatgtcctccaggctcatccatattgtatcataccttagaatttctttcctttttaaggctgaataatactctctcatgtaccacctgtatgttatttttttccctgttacacattaaaaacattaacgaccacgtgtctgtatacttcttaaatcaactgggctaccagaggcacatatggaagaggtcaactgtcctggtttgcccaggactgagggagttcccacaacacaggacttttagttttaaaactggatggtcctgagcaaatgaagatgagctggtgaccccaggcacatggctccattgagggctgtgtaaccacaggagaagtgcacactccacagaggcaaaaatctcaccctcctgtgatcaacccaatgtatagaaaacaagataatggcagggcctattgtaaccttttcctatgcctttaaaatcattatgaaagcttagatcacagcaagataaagactgaaataccagcaatagcaacatcatcatcatctaacacttgaatgcctcctatgtggtatttgcatctattaacccacttaatcctcatgacaaccctaagaggtagatgctattatatttatatccatttgttattatataaacgggaacatgtatatacatggatttttgtgtaatgacctatgctgcttctctcactcatcagcacgtacaggcagacttcatccttttaacggttgcacaggatcctatagaatgggcgtagccagctgggcatggtggctcatgcctgtaatctcagcactttgggaggccaaggcaggcggatcatgaggtcaagagattgagaccatcctggccaacatggtgaaacctggtctctactaaaaatacaaaaaaaaaaaaattagccaggcatggtagtgggcgcctgtaatcccagctactcggaggctgaggcatgagaattgcttgaacctgggaggcggaggttgaagtgagccgagactgtgccattgcactccagcctgggtgacaagagtgaaactctgcctcaaaaaacaaacaaacaaaaagaatgggcatagccaatgccctagtgatggacacttaggtcatttccattttctcccccttacaactactgctccattgaacacccttgaataactatcttttcacatgtgggcatgataggtttctgtaggatcaaatttgcagatatggaattgttcactctaggattatttttcagtctttaatttcagaaagcaaactacacggaatgagacttctctaagaattgcccaagactcacatcattgcacagaaaccaagcctgtggctgccaggagcatggggaggaagaaggaaattgcaaaggtgatggagttgggatgtcttgcagagctggcaggctcttggctcctccagcaggctggtggggttaagcaggggccttctgggttccccaaaggaccaaccaccagcggaccctggaaaacaaaggaggctcacatggagatggaaaggaccttctgtcaagcaacggggtcagggcagaaccatcctctcccatgcctggagcagctgctgcagctggtgatcatctgtctgccaacagaaccagcatctggactatggggcagcacctcggacagtgcttttcaggaccatggctgtagtcctgggatgagcaggcattgagtccaattcccatctgttcctccaggacctgacacatagaaggtgctaagtaagtattcactgcttaatgcaagcccaagtagaggcccggtatgcagggttcatctctgtggcttctatgctcagcacagacagtacctgccccatgggaagggctcagtccatcattcacttttttttttttttgaggtagagtctcgctctgtcacccatgctggagtgcagtggcacgatctccgcttacagtaacctccacctcctgggttcgagagattctcctgcttcagcctcttgagtagctggaattataggcgtgcaccacaatgtccagctatttttttttttttttggtatttttagtagagatggggtttcgtcatgttggccaggctggtcctgacctcaggtgatctgcctgcctcagcctccaaagtgctgggaccacagacatgaggccctgtgcctggcccatcatccacttctgtatccacatctctgcccattccataccctctgccaggaatgctcctccctacgtctttgcccaatgaactggggggtgatttgggggaaggaatcccagagtcagggtactcatgagaaaatgcttcataataacaattgcagaaagatttccctttgttgctcaccaagtgttaagtgctcgtcctccttaattttacaatacacatccaggaggtactcatttgcggatgaataaactaggactggaagagccttcacagcttgtgccaggtcttatgagtggtggaggggagatgcagacctcagtgccccagggccagagcctgagctgttttcaatcccgctttccccgtggtgaataagcttcaggaatgtgatccatttctgtagacagaggcaggaaataaacaggaaactgcagctgccttctgaagcctactacttcccttcaaggggactgttgttgagtgcgagtcgcacaacaggaattgatacaggtagaacctctgttcagggtgtatgtctttttcctgtgctcctgtaaaatctgaagtccagtaagtttcctcctccccctgcctcatgaatggattctaacccatccttccatctcgtgaatggattctaacccatccttccatctcgtgaatgggttctaacccatccttccatctcgtgaatgggttctaacccatccttccatctcgtgaacggattctaacccatccttccatctcgtgaagggattctaacccatccttccatctcgtgaacggattctaacccatccttccatctcgtgaatggattctaacccatccttccatctcgtgaatggattctaacccatccttccatctcgtgaacggattctaacccatctttccatctcgtgaatggattctaacccatccttccatctcatgcatggattctaactcatccttccatctcgtgaatggattctaattcatccttccatctcatgcatggattctaactcatccttccatctcgtgcatggattctaacccatccttccatctcgtgaatggattctaaaccatctttccccacggcttatctgggggaggaggagacactgccagtgctctctcctccacactccagacggtttatgcaaggaccttactgacatcttctcacccactggaaaaatcagggaagtccagggttgcagaccaacagtgaataaaggccaagttcgggacttgctgaagaagagacaagagcaaaagaactggaaaaaaggcaaatccctgattcaaatgcagtcaaagcacatgcacttgtatgttcactgaagcactattaacaatagtaaagacatgggatcgatataggtgcccgttaatggtgaactggataaggaagatgcggtacatacacaccatggaacactgtgcagccatcaaaagaacaaaatcatgtcctttgctgcaatatggatgcagatggaggccactgtcctaagtgaattaacagaggaacagaaagctaaataccacatgttctcacttataagtgggagctaaaaattgggttctcacggacatgaaaatgggaacaaacactggggactactagagagggaagaggaggagggcaaaggctgaaaaataacctagtgggtacaatgctcacttacctaggtaatgggggccttcatacccaaaacctcagcatcacacaatatacccctggagcaaacctgcacacgtacccactgaatctaaaataaaaggtgacttttttttttaaagtttaaaaagtagtccaaatttacagagacttattttgctaagatacggaggaaaaggtatgaaaaatgctaaagagtatgttttcctggactccacaggcataattccagccaccatgagcaactgaggaaaagtgaactggataaaatgctggcccggcctccaggctcctctttacctcgtcctccaggaagcagctgcaggatcttcctaaaacatgagtctgaccatgtcaccctttgactcagtaccttcagcggctctccatcatctgaaggacaatgtccttaccccttggcaaggcatgcaaggttgtttgtgacccggcactgcctactcaatctttggaattacttgaagttttctaaatgttctgtgttctttcataactctaagactgtgcaagcactgtttggtctcctgggaaaaatatgacttccacttcttcaataggtcaggccctgtgacaaacgcctgggacaggagtgggtaagatggttgtggcacctgtcctcaaggaacgcacagaacactgggggatgcagacatataggtaggtccctgtgatatgaagtgagacagcagatgaattgaagcacgagcattcaggggaggctacaaaaagtatgctggggacaccagggggacagtacctccttctacaaaggcaggcagtaaactggagaactacctggttgttacaacccaatcagttttaattggatttacctttttgtactgacaaaaatgatgtggcattaaaacacactcattgtatttgaatggaccggcaaaccatttcacaaagcctcagtgctttcacaggacatttgtaagaaacacatttttcattttaaacatacatatgcctttctaagaggcagtttatctgatgttctatcaatgagaactcttaacacaccagcccttccttcagacggctgtaatggaaaggtaactgacaacaatcagcacccaggggccacgcaggaacccaggacgccaccggaatcatgaatgaactaaactgacattctgcttggtgggttggggggcgggcggggagggtggggatcgtgtgtgtgcacatatgtatatgaagtctatttaactgtattttgattctcttaagtctgcttgtcctcacatgccatgaggcatctcaaatgtgcacaacatttagttaaccaaattctgcattcccatacaatgattgattacagccagttatttgatttggtcttcagggaaccaggggaggtccacttcagagggcatcgaaagattgaatcttaaaagtaaatgcaatttaagtaggaaagccaagacacggctacaaggaaagctgttttcagagaggtgtttacagtagtttctctctgctccttgccactttcttgccgtttgatttttagcaagttcctcaggctcactgagccttggttttctaatctgccaaatgggagcatttaacaatggtctatgagttacttgtgtgttgtgggtatggtacatgcagtgcctggtgcatagcaggtgcgcagtaactggagttccttggaaagaagtttctatattcttcgctagaaatgcagagagaaaggcatgtccaccccttgctagtttcctaccaagctgtgacatttcaattcttacacacttgtggttcctagcaaaaatttaagttatgtatgttcaagttgcttgactgtaagctacctgaggacaagaactttatctgggtcatctatgttccccaactgtccagcacagaggccaggaacatgacaggttccatcagccttatgcctatttctctttgggtccccaggcccatttcactgtagcccacggaaactgctcagcacaactgtgttgcaggacagaatgagggcttttgtccataccatccctaatgccagaaacatccttcctacacctttgcctagagaactcctgcttgcctttgcaaaagctggctcaatgtcagttccactgggaaaggctggagtataaataaccattgaatggcactgaactgtactgacacgctgacctttctctttgtgcttatggctgagaacagatgcctttttcaccattcatcctgccctgggtttattcaaataatcaccatgacctataatactaatttgtccatttccatttcaccacataggtcttcctaacgcacctacactaatgtatcagaatttgcagtggttaaaataatgcagatctgacatcagagaaatgtaggtttgagtcctagttctactacttattggctgtgtggccttgggcaggtcatttttagctagtcgatgctcaattttgtcatttttaaaattgaggataataacactatttaccttatagagttgaagatgtaatgaaataagagggaataatctgttgcttgcaactacaaaattctagctgatacagaaactggtatcagaagtcgggtaatgagtgttgagccagtgaaaacaagagagatctagtacagcttaggtaacctagcccacagaatgctagaatgtcagatcttattattgttattatttttattatcatgaattctccaggactagagtctgcactgtgccaggagtaggatacagcaaggatctctaactcccagaactttgggactgggtcagtttggatttcagccccaaggtgagattgagcttgaaggacagttgatagtgtcaccaagcatctcattctccttgggcagcttgccacattcacctgcctgtctgtattggaacaaggtcaaaatgcactgcaacacaggcaagaagtcatacacaccatggaaaaacaaacactgtggtttctgcaacacagagatcgattctggaggatcaggacatgctgcgtccagtagactctttacccacagatttccaaggttacttgtttatctcagagggctgatgagaaatttcaaaaggatttttaaacggattttttctttttaaacagaggacacaggccttgaagtaacttgacagttcctaggcaaagaaaacttcagaaatgatttaaatgagacgttatcacatagatcatcggtttttaagctgcatctgggggaaccccaggttggggctgggcagctggggcctcaagacacctcagtagaggtttccttactgaggactcacttccacccctatattgggtaaaatttcaattgtgcaaaaatggtttagtagcctaaaaacaagtgttcaaaaatcatttaaaaaacggccaatttaacttccagttctcctttaggagaggaaggaggctggcatcttactcaatagcagaactggctgagctctgccctcactaactgcccaatcttgggcagatgacaatttttctgaacagcactgttgcctttataataacaggaatcgcaatatgacatgccttgtggagttgttttggggttagaaggaatgatatcaggttaacctgttagcatgggtactcggtgtacagtaaatacttagtaagtattaactatgttactcttgcagctgtgaattaaatttctttttattccctccttccttccctcctctctcccttttttttctctccctcttccatttctctttccttttcctttgtccttttctttcctttctcttcctgcatcctgcctactcaatctttggaattacttgaagttttctgaatgttttgtgctctttcataactctaagatcctgcaagctctattagctttcctggtaaatacaatttcccagttcttcagcaattcaggccctgccataagcatttgctgagcatcttcctatgtgccaaagactgcgttcatttcttttttttttttttttttttttgagacggagtctcgctcttgttgcccaggctggagtgcagtggcgtgatctcggctcactgcaacctctgcttcccaggttcaagcgattatcctgcctcagcctcctgagtagctgggattacaagcatccaccaccacatctggctaatttttgtactttttaatagagatggggttttgccatgttggccaggctggtctcaaactcctgacctcaggtgatccgcctgcctcagcctcccaaagtgctgggataacaggcgtgagccaccgcacctggccgactgtgttcatttctgacttgagacatgaattctgctttttcaacagctgggtatcactttgagttgtatgggcccatttcattgaggacatttaagcccgggttttatttgactctacatgagctcatacctcctgcttcttgggtaaaagctgttcatttacagatatttctttcttttcccagagaggtatttactcaggggcaataccttagtcctgctccttctgcgctcctatggtgactgatacagtgctttactaacaaacaaacaaacaaacaaaaaaaaccaaattagtaacaaatgtcatctgggatctgatcacataaactctgccgggaagatgctgacacaagttcattgctcgctgatgaattattttcagtgccaggtctctgagtatttaaatggctgcattgtaaaaacaggatcgtattataaattgtcaaacaggacgtgtagtagatgaaggcagatttgtgcacgccacactacctccacgtactcattcagcaaacatttatgttacagctactatgagtcacgtgctgtttcagatgctggagaaacagtgaagatgaagacaaaatccctctgagaatggagctttggtgttccgaggcatccacgtacatcctggattagcttccctctatgcattaagagcatactagtcacataccatccttgctagaatcaagaacacaggcactctgcccacttcctgtgttttgtggctcaaatgaggaacctcagttgagcaaggcttggctagcgccatgtctggcatattatagttgctcaatgcacacagggacaaaggttgaatgcaatctccgagtctgtgccaggttcctggaatggaattcacaaactcggacagaattcctttcatgctaaggcagatacatcagcaggtccagctgagacgagcctaactgagtgacagcttgacgtgctgctgttctgcagaatcatcattcggcaaaaggtgaaataggtttaaagatcatctctactccttaatccttgcggtaccaccttgcaggtttctttatccttctgagcctcaatttccttgtctaagttgagcaaagatttgatgagatcatgggtgtggaagactcaatccagtgcctgccacatagtaatcgcttgattatctggtagcccttgttttttatttggctctgagtgagggagaagggtggcaggcttccccaggctgcaatgtgcagtcatcaaaggttttctcagggaagctgtggtccttgggatgttgacgaacccaagagttagagaccaaaccaagaccaacctctctgtggttgttccctggctggccctccagagggtggccaaaaaaataaataaataaaacacaaaagaaagatatacatctacagaagctgaaattcctctgtttttctactttatcttattacttcttccctttttctctaaagtagctgaaccacatatgttaagagtcattgtaatactgaaaagaatggaaaacaggtgttcgaacaaaacttggccatgctattcatggcagcactactcacaatagcccaaagtagtaacagcccaaatgtccatcacctgctgaatggataaagccaaatgaggtctatccagacaatgggatattagtcagccatagaaagagatgaagtactgatacaagctacaatgcagatgaaccttgaaaacataatgctaagtgaaagaagccagacgtgaaatacccacatgatgtatgattccatttatatgaaatattcagagttggcaaatccacagaaacagaaagcagaccgggggttgccaggggttgggggtcagaggggaatgaggagtgactgcttaatgggtacaggttttccttctggggtaactaaaatgcttgtaactagatagtgattatgctcatataccattgtgaatgtattaagcgccactaatttcagttgtatattatttttggcatattaaatataacttgttttttgagatgaagcctcactctgttgcccagggtagagtgcactggtgcgatctccgctcactgcaacctccacctcctgggttgaagcgattctcttgcctcagcctctcaagtagctgggattacagacatgcaccaccacatctggctaattttttgtatttttagtagagacaggctttcatcatgttggccaggctggtctcgaattcctgacctcaagttaccgccctctttggcctcccaaattgctgggattacaggtgtgtgccaccacatccagccaacatattttaatgttattatttatgtttttatttttatgccacaataaaaatatgacagttgaaccccaaaatttcaaactgagaaataaaacaacagctacaataataaccatgtttggtgtatcctacctattttatatacgctatccacctaatcctcacaacccccctaaaataggcagcagtagctccattttacaatggagcaaacttctcaaaacttgggcaacgtgtctaataatcatgatgatcataacaataataagtatagaatataagagttgcttgctgaggcacttgttacatatcggctcagtttgccttcccaacatcatcatgatgtacatattatcattatcacccattttacagaggaagatgaacagagaggttaagtgacttggcctaggttagacagcccacaggtaacagaaacagggatttgcacccaggtcatttgacctcagagtccatatgcatcaccactggagcccgcaggcgtggtcatggagccgggaaggaatgtggacacctgcagaacttacctccctgtcctctctcatggaaaatgggaacagactaggtatctgctccatgacatcaagtgacttcatgggatccagaccttcccccaggctgcatggaagccagcatatagccagacaggtgtgatatgtgaatgtccctctggcctgccaggctcccagacacagatccttgatatctgtgcaggcacctccactttatgtggagaagcagctgagccaaccttaggattcatgagtacctaccacagctcactgtccttttgaaataaactctccagctctttggaatgttttctgttttcatggtggtgaaatctgaaaacgtctctaggtgaaaagacattaagtaaagacaaaacccctccactggtcctcaatctaggaataagcccagagatgtttttaataaatggggaatgcaaaaaaaaaatgcggtaaaatatcagtgactctcctggcacttagaaataaaggaccacagccactgcagccacagtggtgttatatgggacaaacactgagcactcatttgctccttcatgccttacttcagtaagtacttactgagctctcactatgtgccaggcactgtaccaggaataagacacagtggtgagcaaaacagatgtcatctctccacttgtggaactgtcacccgggcagcttgggtcaccatcactatcatcgtttctcgagccctttctctgggtcaggcaaggtgctacacatttcacagcttcatccttacagtaaaggctgaggcaggtaactgatggttcccattttacagatgagaaaactgaggcagagacaggttgagcaacatgcccaagggcacgtggccagtaaacagaacagctggaaattgaactcaggctctgctgcctcctcaagtgcacactttcaaccgctttgctgcactggcctgagggcctgagccctggaaaattcctgccgactagcagaaggaggtttgtaggtccagttccagatccagcttacagggtctctccaggaaacccagggccacgaagcctaagaataaggtatgctgcagaaaagctcaacaccaagagaaaataatagcaacaaagcaacaggaggcatttagcctggtggaaagtaattacctgagctataatgtacatatctactagcaaaaaatactagctatcatgtttcccctcctccagcaggctggtacagtcctctactttttttttttttttaactttctttttcccactgccaagcaactgattataaactgaaccaatctcatcatggcattttctaatagaaaacttttcaaaggcttcccattgcttataggataagcttggactccttaacctggctctaaaggtcccacacggtctggcccccacctgcctctctggcctcattctattggcttatccccttgccacactctgtccacataagcctcttttcatttaccacagaagccatgttttctcctgcctcagtgcctttgtgcatgcagcccctgctgcttgcaatgttcaccgccccctttttttcacccagttaattcctcctcttctttcaactctcaggaaaccactgggcagagggcactccagcctgctgcccatctccttcttagttttacataaaaggagggggaactgatggtaggattacttagtgccagtgagattgcttgagacgtggttatgggatgggtacttctccagggaagctttccctggtcctttagaagagaaggggtgatatgcatgtctgtttcctgcattatatgcatgcaaatttctttcctgacaatgtcatgaagatgtcattatttgatggcttaatctgtatattcctcaaaggcagcgatgttaatggttctattggtgtctgtaaccccaggtcctggcaaatgtctggcacacagtaggtttccaacaagcatctgttgactgactagaatgtatgaatgaatgaacaaattcacagtgacgccctacagctgatagttcattaaaatgtattttgcggacaccaccttggttaaaaatctctctcttcctgaattaacattgcaacctgagacagacttccaagataaattacaggaggggagcccagacacatccaggcagtgagtcagtagaaaaccagacacacaagatcaactggatttatagaaagtactagaggaacacatgtccagtcactctgggaaatctttgagaattagctggcattaaggcattagtcagcaacttgcctggtcaaccaaggaaagataaacgagctctgtgcttttagcgggggagcagaaacttggggtaagtgctgaaatcaacgagtctcaggattcaatgacattaacctttttgattcagattgaggaaggtggtgcagggtgaattacggtgctaatgaggaccaggtatttatcctgcgtttaggcagagaaggctgggtggtaagaaaaccggtatgctctggctggcaggaactctgcggggctggatagccatggaggactgtctgtgtgcaaactgcctgtctcctctcggccgcccctggtcaggcaacactgatgggtgagctgtgtttcatgtgctccttaccagctcaaggtcagaaatggcacacgaagtaggttaggggaacataaaataaagggagcctgctgtttaataaggggttcagctacccaggactgggtagaaatccaggtcaaggcctaggggaggtagagcagaaggccttggggatctccatcactcattctctatccagggtcctgaagtctgaagcacttgaggtgattcagattcaaccccacctgggttgacagaatcatctaagatagtgaagcaaaggccatgcctaggaagatgggtgagtgggttggcactaaatttgaaagggctgagatgtacgtgttctgggcaaggccacgatctgaaacatgggagatctggcagaatgatcaagtgcaaactattgcctgccacctgtttttagaaagaaaattttactggaacacagtcatacccattcatttacatactgtctatggccgccttagtattacaacagcagagtttcgtcatcctgagagacatatatgtaccacaaaacctaaaatatttactatctggccttttaataaaaacttttgaggctgggcgtggtggctcatgcctgtaatcccagaactttgtgagctcgaggcaggcagatggcttgagcccaggagtttgagactagcctgggcaacatggcaaaaccctgtctctacaaaaatacaaaaattatccaagtgtggtgacatgagcctgtaatcccagctactcaggaggctgagatgggaggaccacttgagcctgggaggtcagggcttcagtgagctgtgactgtgccactgcactccagccagggtgacagaatgagaccctgtctcaaaaaaaaaaaaaaagtttgttgaatgaacggagctggaggcttttatcctaagtgaactaacaaaggaagagaaaaccaaatacatattctcgcttgtaagggggagctaaacattgagtacacacggaaacaaagaagggaagggtagacaccagggtctccttgaggaggcagggagggtgaggatcgaaaaactatcaggtactccatttatcacctgaatgatgcagtaatttgtacaccaaacccccaggacacacaatttacctatgtaacacacctgcacatgtacccctgaacctcaaataaaagctagaaaagaagtttgttgatccctcgcctgataactctcttttttgggtcattcacaatcttcctcataactttctggcatatccgtctaatcgaagtgtcttcctgacccaccctatcctctttccatgcaatagttttcctggtactcatttctacctgatatatgacccgctcacttatctactgtctctttctctaatgagcatggaggatgcacaacagtgcttgctttctttactgccatattcccaacccccagcaaaatggctggagtataccaggcactcaataagtacttgccaaatgactgaagagccacttaccccttgtattgttgccttgttaatattttctcatttaaatcaactttcattttatttatttatttactttttatttttaaggaaacttcagcttccaaaatctgggctgaacatgttcctattcccttctatgtgttaatatagataaacatggacattttcaaagactcgcctgcatttctctttaaatcatcttacatactgcaagcggcccacaggccatacttgggaagtcctgactcattgttaaggacatgggtgggtttaagctccactgagctccacttctgggtagctgagcatctgctcaagtcccttctcttgcaaatggggacaatgaaggtcccatctcaccagatggctgagagattaaaggagaacatagaagaagcacttagcacctgcagaaactcagtggcagggaactctcaggggtggggccatctcccggtcgctcagttcatgacaaagcagtgcccccttggtactgcagccatcactgtcatgaagcctgtctgagacactgccccaattcctgaatggttgcaccacaacccagcaaagcaatttggattaatgggactatttagctgtaggtgtccagagaatgcattgtttaaagtaacttgttggaaacttccccagggtggcaaattttaaacaaagattgactctgtaatcaaaaattgcttctgcttggccttaaaccagattccggcatcctgaagagcatgattagactgagaaagggtggcaatgtttgtgcccctggctcggtttgccaagtaatgttgactgatgaatacaattaaattgcactgaggagaatccctccctggaggagaaaggacataggagacgggtgatggcttttaggggcacagtttttcattccttctccataagggaacaaccaccattgtgggattccccttcaccccctaccatgggaaaactggccagtactaccaaatggccttccccttcccattctccacttttggattaactggtcttataggcagtgggccaagactagattccaggttctagagacactccatctgaccttcatgggcctgcttcacctaagctgagtgggagtgggaggaggcagcaggggagtctcatgaaccatgaagactttgctctctgcgttggcttctgttccatgatgatttcctaggaagctgacctgcccagatgtccaaatcactttctgatattgcctggggccaccaggggagggtcagaggcaggccacttgagcatggggatggggtgagggttggtgaggctgggaattggaaggaagtttcccacttgaaatttcaggtagattgcagttgcattcaaaaagtaactggagaaatgcacttgatttttcaaagtaagtggagaaatggacttgagaaatggaatatgttgtttcacctcattggggtagagaaggccagtaaacactagggctgtcttcaaacagccttgcagcagggagggaatatgggggcccaactacaggcaaagaaggctcagctcaaggcaactaccttcctcactctcatcacgatcagacttcctcaaaggcaggtgccccctgcccaatctgcatttctgtattagtacaaggaatagagacataaaatataagaggaagaaagaaggagagaataaggaaagtgaccacacaaggccagaccatgtttttgtccagaattaataactatacaggattattaattatcattgtcatcactaccattatcatcaaaaaatttccttgttaaaaaatgcccaattccggattaggtcctgtgttccactatctttcatgtttctaacaatcctatgaggaaagtaccctggggagggcactctagcctgctgcccatagcaggttctcctctgcccatctctctcctacatttacccaaagggaggaactgagggtaggattacttagtgctggagagattgcttgagacatggttattagtgggctagatatctgttctgtgaacccttcctcctcccaaatgaattgcacttcttttttttttaatgtttcttgcctcaggcctgggtggtacttaagcctcttggggccacgatgagttaccccaaccgcttgatgcaacggggtgggtacagtaagctaaggtctccctggtggattcaaccatctctccttgctttgtatccatcagtatgaccaagcatcctggtcccaatgttttgatggtgagaaggtggagaggaggtcacatggagctgccagacctgagccaccatgctctgacctagctgtcatcaaacagcttgaaataaagcagtacctggagtcccacctggctattcttccttttaccgctccctgatgggtagcatggtcatgccctctcacaggtgagaaaaaggagactcacaaaggttggatttgttgcttgagagcatatagctctcatacaggggatgaggacaggtaccttggtctgtacaggctgctataacaagacaccataactgggtgggttaaacaatggagatttatttactcacagttctggagactggaaagtccaaagtgcctgtcaattagatgctggtgaggcctctcttcctggcttgcagaaggccaccttcttgctctgtccttacatggcagagaaagagagagcgagctctctggtgtctcttataaagaaggacactccttctataggatcagggctccatgcttatgatctcattttaccttaagtacctccttataggccctatctccaagtacaagggttagagcttcgacatataaattttagtggggcacggttcaatctatagcaacaggattcaaatccaggtcaggctgatattgcatggcctcttctacatcgtagtggaatgacttgatggtgtagaatatgccagcattgctttgagtttgctttgattttgctttgaaacaattaggcatatgtggggggtggggtggggggagggacagaagccattcctttctaattatgcttgcattaggctaatatttaaatgaatgagaattccactgggcaccaccagatagccagttagggtagagatatggagagtctgaggtccaatgggaacaggattacaaaggaatttgaaggttggggttgttcttgctaacgcaggacagatggttcctaggtctatgcttagagcacacagtcagtaaagcttggatattccattagagaaagaaagagaccatctggagatgggtctacactggcttttggctttggcagccacatcgtagtgttggcatccttgggtgatcggctttccctccctggggtcaaccacttacacaacacactgcataaagcatggtgaacttcagggtcagctaagcctgcattcaaatcccagcttggccacgatcaagtcatgtgacgttgggcaagtcacttgaacactctgagtcctggtgctgttctatatgtcatcttactgggatgccatggggactaaagcagaaagtgggggcaacttggcagttggctaaacattaggtcactctggatctcaggttctgatgtaccctgctcatctcttgatacgtggacaactctgcctcctggattctcatccagatacagaaaccaaggatttagatggggaagaaatgagtgagagagctttaccccagaactatccagcaggtgaaattatgacccgttggcaaaaaactcaggtcctttcctctctgcccctactccccgtgatgaaagaagcatgcatttaaatcctggctccaacccccaccagttgtgagacactgagaaaatccctttacttctcacagccttggtttcttcatactgcgatgcagtaacactatctaccttctgggattgttgtgagaattacatgagataatgcatggaaatcacttggcctagaatcctatgcacagtaagtagtcaagaaatgtcagcaaatatgattagctactggagtatggcaggtcttaaaaggctttcccaggcatctactttgagtggctactattgaccatgctggacaatgactcagggtgggagcaagggagagaaaatacttgaatgataataagaataatccacagagtccgtctgtgtgcctaatgatcagaccttaaccctgtcgcttggatcctatactcagtcaaatctttgccctcatcaatttttaaaagggtagaaacgctcctcccttatcccacttttaatacatgcggttcctccagattgcccttgaaaagaatcttcacctgcagttagatgtaaggaacaggcaagggaagaataatagactctacaataaagaccacccacattgtagaccaccccgggctcacatccaaattcccaggatgcacttggagcatcccagcatggataccgtccatactcttggccaccggagaaaaagtcacataaaagacggcttttttttttttttttttttgccaataagcaaaaatgctcaatgcactgggcaggaagatgccagggttggaaacgtcccatccacagacacatagagagccgctgccaagaggaaggagaattgtgagatctggagagggagggattcggaagaaaatacattgcaaaattcattgtgtggtcaagctgggatctggtgagaatatcaaattggcagaggacagagaccacatttatttctgtactatttagcctggactctcttttcttctggtaacagtagtataattctctctagtggaagtgtttgtaccccatggcatcgatgtaaggttcatgagcgcacagttttaatttaactttaaattaaaatcatatcaaattgaaaatttagttcctcagtcccacaaggcacgtttcaagctctcaatggccacctgtggctaacggctaccatacaggatggtgcttatagaacatttccatcacccccgaaagttccactggacagtgctggtctagagcattgcctaatatctagcagaatctcaatgagcatctatttaatgaatggatgaatggccaagtgctctattctctgctagccaaagaagggatacacaactcaagagagaactatcacatttttccccaggactctgaattttttttgttttccgttgtgaaagaaagagaaagcaaacaaaatagcaagcaaacaaacaatacaactaaaagttatttaagccagatgatggcatcccttgggtgaagcagtcacttcaattcttgtcttccaccacatccttcccagaaggtcctaagcccatagaccactcttggctttctgcagaaccttggttttcatgagatctccgagaactctaggctcactctgtttgtccagccgatggtctaggtcacttctggccttaagaaggcttaaagagctgaccagcctaaaatacagctcaggagacccaggacaactggcaagagggaagcaaactgcatttctgcaaaagcaggagtgtgtgctccatcagcctgaaaaataacagggctgaggatatgtttattttgtgactagaggcaaacaaaactgttaacggcataattactggcatgtttttccagtctccttgtgaacaacagtccgagcagatacaccctttcaaactcacacattatctgggtggaggttttattggatggtttcgaacccaggaactttggggtctcaggaagcagagtgtgtgtctctgaacgtcccaaagaacaaaagtggtttggatgctgagaaagcagaatgcaggggagatggtcacacccaaatatctgagtgttgggccaccaagtatgctttcccacgaagtactgaggctaacattttccaacacagcatgtagcttctatttatttttctaactatgtgaaagatgtctctctctctccctggaccagtggatttcaattctcactagtacaatcacctgcagggtgctggacactttaaaaatatatagattcttggctgggtgcagtggctcacacctgtaatcctagcactttgggaggctgaggtgcgcagatcacttgaggtcatgagtttgaggtcagcttagacaacaaggtgaaaccttgtctctactaaaaatacaaaaatcagccagatgtggtggagagtgcctgtaatcccaggtacttgggaggctgaagcaggagaatcacttgaactgggaggtggaagttgtaatgagctgagattgtaccacactccagcctgggtgacagagtgaagactctatctcaaatatctcaaatatatatatacacagagagagagagagaaattgattcttggcatccacaaggaatttacattcagttgatctggaacggaactctagatttcttttttatttttattttttaagacggaatttcactcttgctgcccaggctggagtgcagtggcgcgatctcggctcactgcaacctccacctcctgggttcaagcgattctcctgcctcagcctcccgagtatctgggattacaggcatgtgccaccatacccagctaattttgtatttttagtaaagacggggtttcaccatgttggtcaggctggtctcaaactcctcacctcaggtgatctgcctgccttggcctcccaaagggctgggattacagacgtgagccaccatgcccagccgatttctttattttgagcctcccaagtatctggcgttacaggggtgcaccaccacacctggttaatttttttttttttttttttagaaatgggggtcttgctttgttgcccaagctggtcttgaactcctgggatcaagtgatcctcccacctcggcctctcaaagtgctgggataggcatgagccactgcgcctgctgaactctgaatttctgagaatcacatagaaccttgatttgacccggctgagaagcacatagtgagatgtcaagctccttgtggcagggatggtgtctgtcctgctccctgcggaacacccatagcctgacgcatgacgggtgctcaggaaatggccttgagaagcagctctatcctgttttaagagtctggctcagcctgtcttctcctgggagaccttggagtccccgtcagagcacacctgtgctaatattgcaggtgtaaggtgaagagggtctgacctgggtggggatgaagggcatcacagatggggatgaacacggagagatgtcagggttagaacgagaatacgcaaggtgcagatggagcagcaaggaagggggcacacaggcttccagctgcaggtgctcaggaggagggtggtcctattcagagaaatgggggaaccagaagggtgactgatataggataggaagacattttggattcttctaaaatgtagaagaatcagtccaggtgtggtggctcatgcctgtaatcccaggactttgggaggccgaggtgggcagatcacttgaggccaggagttcgagaccagcctggccaacaaggcaaaaccctgtctctactaaaaagacaaaaaaattagccaggcatggtggcacgtgcctgtaatcccagctactcgggaggctgaagcaggagattcccttgaaccagggaggcggagcttgcaatgagccgagatcacgccattgcactccagcctgggtgacagagcaagactcagtttcaaaaaaaaaaaaaaaaaaaaaaaattagccagatgtggtggtgcataactgtaatcctagctacttgggaggctgagggatgagaatcacttgaacctgggaggcaaaggttagagtgagccaagatcgcaccactgtactctagcctgggtgacagagccaaacgctgtctcaaaaaaaaaaaaaaaaaaaaaagaaagattaaaaaggtcaattttattttaagtgtattttatcacttttcttttctttcttcttattttctttttgggatggagttttggtcttgttgcccaggctggagtacaatggcgtgatctcagtccactgcaacctccgcctcccaggttcaagcaattctcacttattttatcattctcaccatattttatcactttaaaaaaaaagaacaaaagacaaagaggggtctccaccatattctttctcacattcactcaacccacattcttcctctaatcctctggctgcgcccctgttggcttatgattggcttttttctgacccgctctcctaagatccttgcatctcacgcttgcttctctgttctctgctccagctcctgttgaaatcctctgagtctcctgaacgaggctgttttgcacaggtgtggggtcctggtccccaaacagaaggtggctgcctggctctgagtgactaaaagacttcatggctgcttgggttcaggaagctccttatggcttccttctaggacacctgcttctgcctggaggtttggagaatagggggctctgtggatgtggctctggggtcagtagaagcaactgcttgtgatctggcctccccactcccatttgggccccactcccaactattctcccacggcagccagtacgatctctcaatgtggcaaatattgtcactctcccctaaaacctcaccgctcacagactgaggctttagtgacccaacaggacatctcaagtgcccacatgggcttgcctcgacctacctcatttgtaagaaggcaaaccctcgcctcttatgtttcacccatagttgccttctttcagatcctcagatatgccagggtcccaagctaccccctcttcctgggatgcctgcttggaacctcctcacacttctcctaaactcctacccagcatctacatctcagttcacaggctgcctcctcagggaagccatccgggccctcagtccatgtgagattcctttgcaaagtgctcatagatccttcattcctttttttcacaatgcttgcctgactttgtcatatgtgcactcctgtgatctctgtgattaatgtctgtctccttcctctattaataaccatggctatcacatggataaccctcactgtgtgctaagcacttcacatatatggactcacttagccctcaaagcaaccctatggggtggtgccattattatgcccattttacagatgaagtaactgaagcacagggactgctgtgtgcaacttcacacagctagtaaataaagaagctgcgatttggacccaggtggactggctccagcctgtacccttgaccactacgatgagggcagggctggatatgtttttcctcacctttgagttgctgcttagcacagtgtccaacacatagtaggtgctcaataaatatttttttgggtgaatgggtaaagtcagaaggagccctgtctcctgaactcatctgtgggagtagagaagtatcttcactgggctgacctaagcactttcctcctcaaagcaccccaagattgtcatcagaaggggcttggtgttgagagaaggaagaagggaaaaagggaagcttggacctcacactctactcctccacatttccatcttcaacctgaatcttccccggacaatgagaatcactgaagtttctttcccgttcagctgaggtccaggggctagcatgggtagagaagatccggtgtgaatgggaaaggccatcaggccaatatgctcagatctacaaccccccatggccaaacagtcaccagggcttgcttaacaagagtcctccagcaccactgctgggcagagtcccatatgatggagctgcatcttcttaaaccagatgaggtcctcaattcagggcatacagtgcagatacaacatggccaggagacaggggctttgggaagcttcagaatgctgagtatattgactgataattggataaacagattgtggtacaagtatatcaacatgatagaatatcagccataaaaaggaatgaagtgctgccacatgctacgatgcagatgaacctcaacgatattaagctaagtgaaataagcaggtcaccaaatgtcatatactatgtaactgcattcatataaaatgtccagaataggctgggcatagtggcttacacctgtaatctcagcactttgggaggctgaggtgggtagatcacatgaggtcaggagttcgagaccagactgaccaacatggtgaaaccccatctctactaaaaatacaaaattagccaggtgtggtggtgcatgcctgtaattacagctacctgggaggcagagccaggagaatctcttgaacttgggaggcagaggttgcagtgagccaagatcgtgccattgcactccagcctgggcaacaagaggggaggctccatctcaaaataaataaataaaaatgtcaagaataggcaaatcaagtccatagatacagaaaggagattagtggttgccagagactgaggagaggtttctgggaagtgactgcttaatgggtacagggttttcttttgggatgatgaaaatgtttaggattagagagcgtacggttgcctgacactgtgaatgtactgaatgccattcaacaattcaaagtggttaattttatgttatataaatttcacctcagtttctttttattattatactttaagttttcaggtacatgtgcacaacatgcaggtttgttacatatgtatacatgtgccatgttggtgtgctgcatccattaacttgtcaattacattaggtatatctcctaatgctatccctcccccctccccccaccccacaacagtccccggtgtgtgatgttccccaccctgtgtccaagtgttctcattgttcagttcccacctatgagtgagaacatgtggtgttcggttttttgtccttgcgatagtttgccaaggatgatggtttccaccttcatccatgtccctacaaaggacatgaactcatccttttttatggctgcatagtattccatggtgtatatgtgccacattttcttaatccagtctatcattgatggacatttggattggttccaagtctttgctcttgtgaacagtgccacaataaatatacatgtgcatgtgtctttaaagcagcatgatttataatcctttaggtatacacccagtaatgggatggttaattttatgttatataaatttcacctcagtttcaaaaaaaaaggatcatgattctacagtttactggctgtagccttggggtcaagtttcttaacatctctgtgcctcagtttattcatctgaaaaatggggatatcaagagtgcatacttcagagttgttgtcaaaacgatgtaaacaagcttgtccaaccctgccttatttggttgttctgttttgtttttttgttttaggcttttagcagcctgaagccatggtttttagtttctgtctctagtgataagcagaaaagagggatgaggaaggggctttactggcccaaccaagaaaagaaactgaggagccataactgtattctctccctcagacatccctgaattgtaaagcacttagaataatgctaggaatgtacgaagtgctacatatacatttgctgtggttgctgtgcggtcttaactacaggaattctttgacctattcgggttccactttagcagactaaagggatgtgatctgtacgcagatgcagtgactgtacatggatgcttggacttccatactgctcatcttcatttcaaatcccagagtgactgggatctgtgctgaacattatcaagggcttgacttccctgcaaagcttcctctgctctgtgttaatactaatttctctaaacttacttaccaagtagcagttgtgttttgggggatgggattaagaagaaatatgtggtaaagggccctgaagagggcccagcacacagtaggtgtgcagtaagtgtctgctctgttagtctgggggttagtcttgctcaattggtcccatataaactctggtcttcgggagactgtagagaagccctggccacctgttcctgtctttaccagctggtgtttcctactgaggcgccatggagcagctctctcatgttctcagcctgcggctctggtagtatctcaagacagacatttggatctgcagttaatgtaacttacatgtccatgtggtgggccctgatagtttggactttgttgatgtggatacccaagaggcagaagtagcaggaaaatgtcaacatggtttcccctgcctggtttctgtatacatacactgccccacatgtgcaaacgtgtgtacacaccacagactgaatgtgaaccccgggaggggccaaggacacactcaaccctcctctctttacatctgatttgccccaagacaccggacttaggaaaagacacagtgtgaggcgtgaggtctctctctctctcttttttttttttttttttttttttagatggagtttcactcctgctgcccgggctggagtgcaatgtcatgatctcagctctctaccacctctgcctcctgggttcaagtgattctcctgtctcagcctcccaagtagctgggattacaggcgcccgccaccacacccagctactttttgtatttttagtagagatggggttttaccatatcggccaggctggtctcagactcctgacctcaggtgatccacccatcttggcctcccaaagtgctggtggcattacaggcatgagccaccacacccagccgaggtctcttactacaagtccaagccaagaaacagggcaaagtgctattggcttcatctcttcctgcagccaatctaaagtaggccaggtataattccttgcctcggtaaatagaacatacgaataaaaccatcatacctttcgaggattcaagatctagcagggcctcagagtttgaaagtatccattttccactttcatccacgtgctgggtacacaaccagctccagctggagcctacgtggaccaggatgtcatgtcaacagcagagcaggagcacctagagtctctaaacactctcagcttgcgtatgccaagttcaggaatattcttcatgtccacaagtgaattggatctattctgtttttcttgaaacagtctcacgtctatctttgcttttcccaccctttttttttttttttttttttttagacagcgtctcagtctgtcacccaggctggagcgcggtggtacgatctcggctcattgcagcctctgcctcccgagttcaagtgagtctcatgcctcagcctcatgagtagctggggttacaggtatgcacaaccatgcctggctaatttttgtatttttagttgagtcggggtttcatcatgttggccaggctggtctcgaacccctaacctcaagtgatccacctgccttggcctcccaaagtcctgggattacagttgtgtgccaccgtgcttggcccacttttccctcttttgacagagatgtgagttcaagaaatactttgctactcttttaactctatcaaagagaaaagggaaagtaactcaagtcccacagttacttatagccatggagtaatttgggcatttatcaaccactttctgtcattagacgctgtggtaggtccttatcatgcaagatttcattgaaacttcctaagaaccctccgaaataggcactaatattgtgtttattttaaggtagagaatttgagatgcagaaagttgaagcaacttgcccagttggtggtggggcagaatctgaaaccaggatgtctgcgtccagggcctaaacaaggctagtgaccagtaaacaccagtgcatctttaatatctaagagaggaagaatctgcccacacccccccaccccccacagtgagggttgtgcaggggacacagggaggtgacgtcaaatcacagagcagctcacagtggctacgtcgggctggctggacccttaagtatcccccaagttttcagtgcctcttagaagtgcctgacttgggcactaccgcccctttgagaagactcctaagtttgctcattctttctgggatgggagaagtagtggttttggaagctacagatggggcggcagatggaaactgaaaacctatcagcattgcccaggatgaaaccattcatctgcaaaattcatatgtttttgtgtagggcaacttcatgaaaacaacagcaagaggaaccagcagtgcttgatgcataaagtgcctctggctatgaggctggcaaagaagagtgggcaaaggaattcgtgggaggcaccatggaaatgagatcagtgaagtagaggaagatgatgagaaaggccaagagacacagagtgacctggggcactaaagcaaaaaagccacaaataagacaactctcttttctgaaccccaaaataggttgcacgcatggcctgagaaaggatttctgggcctctcagagatacaagatgagaccttggatgtaccttacgtataaatggctgacattcatggagcaccttccaagtgtccggcaggctgctaggttctattattgtatcctgatttcacagaaattggatttacttgcccgcggtcacgctgctagctaagtggcagaactcagattcgagccgtaagcagtttgacgagagtgcaggcactcaccctcccgggtgctgagccgagctggactctttaggggaggtggccacgcaaagcaagccaacaatggcctctagggggcagcaatgcgcatgcctacctggcctcaagtggtcttgggcttaatgcgggcccccaacctaggctggcatgacctctgaggcctccactgggaatccagagaaggaagaatgtgggaactttgagcacagcccctaagactgaggaacagacaatgggggtcctcccaggaccatcctggacatccctgctgcaggcagtccagccactactccaccccgccacaagctcatggggtgggactgtttccttctgtgctttcaaggtggcctggggccatcctgccagtccagttctgctgatttccctaagaggccgactaaaagccagaaggaataccaactttgcaaccagacgaaactggttctaatccccactctgccatgcattcatcacatgacattgggcctcagtttgcccctctgtaaaacaggtttgttgtaagggttgaaacaagtgtctgccacactagctgctatgctcagcattttgggacatttccaaactcggtcccttcatggaagatggagagggaatgttctaacccctccttgccatgtacttgtctaaactcacttctcctcattcttttattatactctatccattgtttaaatttctcaaacgcaacaagtttgtttctgtgctacattgtgcccaggctgttccctctataagaaacggtgattctcaagtggagacaattttagctcccagaggtcacgagtcaatgtctggagacatctgtggttggcaaaagtgggcagggtgtgttcctggcatctagtgggtagaggccagagatgatgctacgcatcctgcaatgcacaggatggcacccacagtaaagaattatccatccccaaacatcagcagtgccactgctaggaatcccagtatagaaggatctctttcttatttccctcccaatggatcccttcttgtcttctaggtctcggttcaaagctgaatattcagaggcctttctgacctcctgcttatggccctcgagtttttctccacacccacatcttcctttttttttgttgttttttgtttgtttgtttgtttttttgagatagagtcttgctgtgtcgccaggctggagtacagtggcgcgatatcggctcactacaacctccacctcctgggttcaagcgattctcctgcctcagcctcccaagtaggggggattacaggcacgcaccaccatgcccggctcatttttgtatttttagtagagatggggtttcaccatcttggccaggctggtcttgaactcctgaccttgtgatccacctgccttggcctctcaaagtgctgggattacaggtgtgagccactgcacccggcccacatcttccttgctttatggcttgttcacaccttgcatgatgtatctttggcatgatcatctaactccatcttctcagctaggatacacattccatgagcagaggagaagtacaggaagctgcatcacttttgttcacaaaatgcactacttcgaatgtagcacggtagttgctcagtaaatgtttgttgaacaaatgaacaaaattgtggtaagtaaaattctaccagcaatgttctataaccattcccgtttatccctctgtcttatggacaaaagaaaacagttgtctttctagtgcctgtcatttttctcaggttcaaggatgtcaggtgtaccccattcaaactgaccagagattgtgcctccccagtaccttctgcagtctagggtctcccagcagatggtgggatgcccccaagcctaggaatgaagaagacccccagtgaccaagctgtgaagaagaaagcagccacttctagctttaaagagaggtaggtcttccttccatgcttgtaccttgtttgggttctgattcaaaactcaaactcttgggaatatgtgacctagatatttgatgccattaaaacatgcctgctaatattttaggtataagcatcattgtgatgctgtcttaaaaaagagatcttatcttttctagatatatactgaaatatttatagatacaattctgtgatatcttatatttctttcaaaataacccactgttgggggaagaggatgaaagtccagatacaagaacaatggccatgaattaacctgggtgacatccacgtgggagttcattacactattctcttggtactcttgtgcatgtttgaaagttgccttaataaaagttttatttttttaggaccccttcatctaggtctcctgggaatgctgaaccctatggcctcatgccatcagagggaggaagatccccctcttcacccccatccactttccttttcacccttgtcagcaaatccagatggaaaacacagtcaaaggaaaaagctgccctctcaagagaaaataacagcctggcacgatggctcacacctataatcccagcactttgggaggccaaggcaggcggatcacctggggccaggagtttgagaccaacatggtgaaacaccatctctatgctacttcagaggttgaggtaggagaatcacttgaacctggtgggtggaggctgcagcgagctaagatcacaccactgcactccagcctgggtgacagagcgagactctgtctccaaaatatatatatatatatagatatatataccgttcagaatatcattcaaagtatcatgccagtggcttccctcttgcttggactaacagccaaattctaggatcaccacgatctggcctcaaattactctctgactttatctctcttgttatgctacccctcacttactctgttacagctccactgaaccctgctgttcctcgcacaggccaggcatggacccacctctgggctcagcccctgcctttgcccctgcctggaccactttctctgtaggcgtgactctctttttcatcttcttctgttcttatccgtgaaaaccttccaggccaccgttggtaaaattacaactgtcccctacttttgccccttactttatttttctaagatatcatttaacttattttgttgtttgtctccctacttgaatggaagcttgtgatggttactattgagtgtcaacttgattggactgaaggatgcaaagtactgtttctggccatgtctgtgagggtgttgccaaaggagattaacatttgagtcagtggactgggaaaggcagacccactctcagtctgggtgggcataatctaatcagctgccagcgtggccagaataaaagcaggcagaacgtggaaggaataagctggctgagtctcccatgctggatgcttcctgcctttgaacatcagactccaagttcttcagctttgggatctttgggccttcgaccacagactgaagactgcactgtgggcttccctacttttgaggttttgagaatcagactggcttccttgctcctcagcttgcagacggcctatcgtgagacctcgccttgtgattgtgtgagtcaatactccttaataaactcctctttatatatacacctatcctgttagttctgtccctctagagaaccctaatataaagctccacgcgggttggagtttccgtctgtttagtgcactggcatatcagctaatagagctgggaaaaccacgtgctcagtctctatctgttgaatgcatgaatgaatgagtgaatgaatcaatgattctcaggtccaatcagaatcctatcctgagcgatcctgtggagactatgcatcagtctccttctgcctcgtgagttcccagccatgaccagccagagcaggacgtcagacaagactggcttggggcccttggctgccttacctgatggggtagtcggccgcactcaggttgatgaagaagtcccagggccagtcggtcatctccaggaggtcccgcatgctctgcaggtaggtggacaggaggctggctcctccccagatggtggccattctccagggggtgacgcggacattgctgtactgcctggagacctggagcacttgccgatgcaggtaattagagcgcttttcccaggagagaaagggtgatgacagtcagtggcctagaaaatacccaggcatgcccctcacccctgtcccctctctgtgtcttccctcctggttgggcacttctgagcacagtggcctttgccaagtaaatgatcctggactggagtgtctttctgtactgcaattcaaacttggattattttttacatttcaaattagctatttgaaatgcagattcactggccgcacttctgagctaatggttcactaggcttgggctggtggtgcctgggacttcacatttttaaaattttatcttattttattttattttgagatggagtcttgctttatttatttacttagacagagtctcgctccgtcacccgggctggaacaaagtggtgccatctcagctcactgcaacctccaccacccaagttcaagcaattctcctgcctcagcttcccaagtagctgggattacaagtatgcgccaccacgcccagctaagtcttgtattttagtagagatggggcttcaccatgttggacaggctggtctggaactcctgacctcaggtgatccgcccaccttggtctcccaaagtgctgggattacaggcatgagccactgcacctggccaactttgcattcatatacatgacagctgcatggggtctgaggaagacaagctgggaaatatggctccatctaaacccatgtatatttcggaggcagaatttttgttttctgtccccactcctactgattgctcctccattatcctctcacaggtctgctagaagccgaccttttggacaagacttccccctttgccttcttgactaaaggcataattgtttcaccaatagaaacctcagggacaaggtagctcgggagtcagcagggctgatgcaggtttttgttaataaagttttattggtacacagccatgctcatttgttgacatgttctccttggctgctttagcacaagggcagtgctgagtagctgtgacagagactatgtgccctgcaacacctaaaatatgtactatcttgccttccatagaaaaagtgtacgcactcctgggatagtgatatggtttggttgtgtccccacccaaatctaatcttgaattgtagctcccataattcccacgtgttatgggagggatccagtgggagataactgaatcacaggggtggtttctcccatactgttctcgtggtagtgaataagtctcatgagatctgatggttttacaccgggaaacttcttttgcttggctctcatttttctctcttgctgccgccatgtaagacttgctttttgccttccaccaggattgtgaggcttccccagctgcttagaactgtgagtccattaaacatctttctttataaattactcagtctcaggtatgtctttattagcagcatgaaaatggactaataaaggtaagctattcccacaaagtatgtgagaggcaggcagagggcattgggtagaggggagaggtaagaaacagcatttaggggccgggcacggtggctcacacctgtaatcccagcactttgggaggctgaggcgggcagatcacgaggtcaagagatcgagaccatcctggccaacatggtgaaaccttgtctctactaaaaatacaaaaattagccgggtgtggtggcatgcacctgtagtcccagctacttgggaggctgaggcaggaaaattgcttgaacccaggaggcagaggttgcagtgagcggagatcatgccacggcactccagcctggtgactgagcgacattccatcaaaaaaaaaagaaaaaaaaccccccaaaaacagcatttatcatttatggacaaaattgtaagtcgcagctggaaactttgaaaccaacacacacatagagacagcactctagggccacacgctctgtggagaggcagctggtcagcttccaagccttttctgaaagcaggcagtctggactagcaatgcagaaggagggtatcagggagggacggacagaccccgaagaaagcccagcaaggggtgatcacagaggcctctcaccttgtccacgtggatgtagtagaagtggtctttgtggtagatggccttgaacatgcgctgcaactgccgagaggcacggccgtggaccaccaggacaaaggcgattctgaccgggttggctggcatgtactccacggagtcctcgtcccactgcacgttcttgttggctttacctggggaaaatccaagagaacagagaggagaaagtgaggctctgccatcctttgcaggggtgggaagtttctctggtgcttcttttggggactattttaggggcacagtcatcaaattgggccttaaaacataattcaatgccacaaagcacatcttagattctcacactgtcaggcacaaaaggggttaggggaccctggggttgttacgacatagtttccattctgaggagcttaaaaatgctggaagagacacatggacacatattaagctactgaacaaggcaggaggaggtgagagctataagagatgtatctctgaatgacagaggaagaagcagttaatttcgagttagtgaacgtaagatacatgtgttgtttttgcctgtccagaattcattctcccttcttctaatagcatccaatatattgtttgttttaacggtggtaagaacagatagcatgaaatctcccctcttaataaatgtttaagtgtacactacagtactgctgcctattaatacaatgttgtacagcaggatctttaaatttacttgtcctgcatgactgaaacttcatcatccaataccttttgtggcatcatcctcctctcctctattcttagtccatatgggtggggaagacctaacttcatcatcaatttcaggggtggacctacagcttaggcctggccaatgggaatgctgattctccatagccacagtattgtttagagatgaacatatgactcaaccaagttaattaaccaataagacagaatgctagacttttgttagaactactacataagagaggttatctttttttttttttttttgagacggagtcttactctgttgcccaggctgcagtgcagtggtgcgatcttggctcattgcaacctccacctctcaggttcaagtgattttcctgcctgagcctcctgagtagctgagattacaggcacgcaacaccatgcctagctaatttttgtgtttttagtagagatggggtttcatcatgttggccaggctggtctcggaactcctgacctcaggtgatctgcctaccttggcctcccaaagtgctgggattacagacgtgagccactgtgcccggtgagaggttctttttctgttacacaggagactagaagattctatgagcctttctgttcccacacggagagaggttgcctgagaagaaaactaatgtggagtacattgccaaggggggatgagggtccaggtgcttgtggcctgccttgagctcctgcatcagtaaggctacagatcacccactgtcatctatcatgttcttttaaatccaaatcctataccacatccacttggataaatagtcccagacatattttattccgaaaatcagcctcaaagactcctctctttctttctcttgcttcagataaaaacacagcttcctagtttagtttattacaatcccaactagaaatctcctagctttcctcagcctgatttcacttgggtccaacccaatttcttaagagttctgggtttatgggacccaggacattgtcagggtagtagctgcaagtgtcccagcatctaaaccgggagaactgagatggagactgtggggctgggggattaggacatcgggagtctaagctgtcatcagaaggctgaatggttgctgaatgaacgaggctctttctacgtagttccaggagacaagacaagattgacgtagataatatccaaatcacactacacagcctctatggctggtgtgatctaactactcagatctctctgccctcgattggtgggtctcacattccatcttgtcctctggccttctttctcttcctcaaacaagctcatttctgccttaggaccttctccctggcttcttgtgatctggaacgccctctccccagatctctgcgtggctgcatcttcttgtcattagttcacagtccaaaaaggggactcaccaccacctcttttactctctttcacctcacccgcacctcttttactctctttcacctcaccggatttcaactttcttcatagcatgtaacactgtctgcaattgtttatctgtttacttgcttattatctgaacacaccactagaacattagctccaagagatgaggggctattttggccttgtttaccacagaatctgcaacacttgaacagtatctgacacacatctggttctcggtgaaacaaaagttacaggaaggcacatttgggatcagtaaaataacaataccttttattgagcattgaccagcccttgacgttcattagataatttaatcctcgtaatgatcctacaaagtaatgctattatccccgctttccaaatgaggaaaccacagcttagaagaggccaagggattggctcaaggtcacactgctttaattagttaagctgagattcaaacacaggtctgattccaaagatcatgccctgaaccactaatacacaccatatgatcatacctagagtttggaaggaaaagtttataacaattgcttttagttgcttgttgctaaccaaatactttgtaagttagttattgcaggcaggtaggcatgcatttaaggactaacataggtattccagtatttctgtattagatgagatgctgattctaggtgattaataaggctgtatcttttcatccatccatctattcctccacccatccacccattaatttattcatcgatcgaaatccaaccactcatccattcatccatccaccattccacccatttatccatttatttgtccatccaaatccaaccactaatctgtccatccatctacccacccattcatccatccctccacccatccacccattcatccatttattcatccatctaaatccaaccacttatctgtccatccatccacccactcatccatccctccacccatccacccattcgttcatgcatttattcatccatccaagtccaaccattcatccattgctccacccattcatccatacatccatttattcatccatccaaatctaactactcatctgtccactcatccatatctaaccattcatccatccaagcatacagcaaaccctccaactatgcatccagcaaagcctccaagagcttatcatcccaaacaccatccatccacttaaggtgtatggggcctttgagattaacccttgcttttccctgtagccatgaacatcttttgccatagtttttgaatgagcaaattaatgaatgtgttctgaagaagagtggctgctctgatccagaggagctggtgtttcttaagtgcctcctatgcatccattgttatttgaccctgggaagaatgcgttatcatcctctgaggctcagagaggtcagcacatttcccaggtcacacagtgagtgaggacagaggtgggaggggaagctgagtgttgccgagtccaaagccagccctgatatttccacttgctctctgcagaagtggagatttgcgatatagaggataggtgtaaggactctatgctggtctttaaaaagggcttggatgttgatgctgaggtcttttacaacttctctttagagttttaaaaggcagaacagatttacagacagacacagacatggatgcttttcttttggagaaagggcagagtcctgtgaaatcaaagacaaatcactccagcaagagagctcccttggcttaaatataaagtcatctttgggtcagacagttagtctggggagctgcaaagagaatggggaacaaaaaacccagagctcttctgagtacagctattctggggaaggggtgggtgggaaggaacaaaaatatctaaagaaaggagacatgcagagaaggagaaatagagatgcggatggggatggggggcagagggggaagacagcgagtcaggagaaagatcaaccatttactgagtgcctactatgtgttaagcaatttctgtgcatgattttattcatttctatcaaaactgctatgaaaacagagctattatctttctattgtaggcacaaggaagctgaggcttggagaggtcccagttataaagtagctgagctgagaatggagtgagtctgtgatcccagagccctgtcatggtcaccatgctcaatcaaactgtcctcatttcaaaaagaggaaaatccgtccctagaggaaatgtgtcagctttcagctgcaggacagatataacaatgacatgtggtcagagctatgtgggtctttatgaacacggaactctttgaaagaccaaaacccaaacagtgcccagctccaaaaaaaaaaaaaaaaaaaaaaaagaatttaacaatgtaatcagattcccatggcacaaaacagaaaataagtggaaaaatcagagtgattagaggcagcaggagaagctgacttcagatgaatgttaacaagccaggtttatcgagagagaatatcaagtatatttttgcagtgcaggtgtgaaggctgaggatgatggggggtcccggagagctcccccagtagatagctgtgctgtgttagttctgttactcaaattccctatttcttagcagcattgtgggtcaaacgaggactatgtaatccttgggctccaaagacatagcagagatgaaggtgctttgcaagggtcaacatgctgttccactgttgtggtgctggcaaagatcatgttagcagtgtcctgcaataatgatttgggaggagaaagcaaggtgcaggggtttagaacatgacctgtggtcaggcagatgtgaatgaccttggaccttttatgcaatctctccaagccttagtattctgatctgtaaaatgggtatgtataatcacagaatccaccccacatggacattcacatccagaagagagagcacagtgcctggcatctagcaaatcctcaataaattatactgtcatagccatcatttctatgtggctgctcatccacgatgatcaggatttaaccaacaggcccagctccagagttctacctcaaagctgcactgactcccagggctgtgtgtactctagagcctgctgcttgtaaataaacatctacaaccggaatttccctctgcagcgtatgcccagaccacaattaataacaaatgtgaaggagctgcttgactggaatagttactctaccaacaaagccctcgattctatttatactctgaaagggctgcttccggctgctgcaaggggcactttctgacttacttccaactaagagggttagttgggtcttgggaacacagagacatggaaacaaggttgtatgcaaatgaggcttgggttaggaagctcccagctggagcccagcttctatgctgcctgggaaggtgtgactgggattcagagctggggtgtagaatgcaaccttgcactgtgtggatttaggaaagacaccgcccctctctgattgtcagttcttcatttacaaagtgggaagagaggtccatctctgaccccgctgggttccagggtgattcatgatcacagatgaggaaaagtttcacagcggcagcaggcgcgttgcagaggagcgggattcgtcttactgggggagaaaacctgcacgctcaaggttctttgttagatctgggtgggagatgcctttatcctagtgggaaattttaaaagaggttttctggtgattaaacttgggagctgtctggtgcccagaaagaatcccctgctctcgatgggtttagaaaaggcggtgctgtgtggcgacaagcatactggataaagagcaacgaggtggattcaaattcctgcttctgctgtgaaccagccacgggggcctgggcaagtcaatttctttccttggtcctgtagaatctcaaagactagtaacgctatcagatgcatgtcaaatacttatcatgcttgcgtcaaatacttctcatggtggcttgcgtctgtaattccagctaccctggaggctgaggcagaaggactgcttgagtccaggagttcgaggctgcagtgagctacgatggtgtcactgcactctggcctgggtgacagagtgagaccctgtctctaaaaataaataaatcagaaataaacaaacactcattatggcctaagcaccagtcaaatgtgatctcattatttaattgtcccaaggtctcaggaggcaggtgccatgttagcagttggtgcgagaatggaaaccaccacttgggtgtgccagactccaaaacccctattttggaaaaacccaaatgagggagatgaaatttctggatatttctggaaatttctgaatcatctggaattctaacccgatccaggagttagcattgccacatagagaactgtactcccttgagagtcaggttggttttcttttctttcttttttttttttttttttttttgagacagagtttcactcttgtcacctaggctggagtgcaatggtgcaatcttggctcactgcaacatctgcctcccaggttcaagcaattcttctgcctcagcctcctgagtagctgggattataggcacctgccaccacgcctggctaaattttttgtatttttgatagagacagggtttcaccgtgttggctgggttggtctcgaactcctgaccttaggtgatctaactgtctcagcctcccatagtgctgggattacaggcgtgagccacagcgcctagcccaggttggttctcttgatacctgtcagttcgttccctatgagccaaggtcatgctcttatctcttgtaggatgccagccttgcccctggacctggtacagagctaagtttgggggagaggcctcaatgaatgatttctgactgacagatttagccagacagcttcatccacatacagggtcccggtggtggggatgagggggcaaagttgaagactcaggcctgagaggttgcccatggctgtctcctctcatccagcaaactggatggaggctaggcacccccacttttccttgaggcttttgggtggtctgtggacccttgctcagcagcaccaagccctgctgggaggaatcagtcaacggcccagactgctctgcaccgcagctgctgctcatgcggggccaccaggtcccctcccacccagcttaatgagaagagaggggtggaggggatgtgaactgggggtcatggggtccacagaggggagctgaaagaacataggtccaaggatgaaggtggccaagccagcacctgtcaggtctcaggagaaatgacccttccttgggaagccctccctgactctcttccccatcccttcatttaaaaaatatttttaatgacttttttttctttttctttttcagagattgagtcttgctttgtaacccaggctggagtgcagtggcatgatcataggtcactgccacctcaaatttctgggctcaagggatcctcacacctcagcctcccaagtagctgggactataggtgaccaccaccatgtgggctaattttgaaatgtttggtagagacagtgccttgctatgctgtccaggctggtctcaaactcctgggctcaagcaatcctcccttagcctcccaaagtgctggtgttataggtgtgagctactgtgcctggcccccatcccttctttgagttccctgtcacagcccctctgaacatcctgcacttctctttaaaaaaaaaaaaaagttgtagtccaagataatacatgctgagtatcccttatgtgaaatgcctggaaccagaagtgtttccaattttgaattttttcagattttgaagtatctgtgtatatgtaatgagatattttggggaagggacccaagcctaaacacaaaatccatttctgtttcatatacactttatacacatagcctgaaagtaattttatacaatattttaaataattgtgtgcattaatcaaagttgcattaagcatttatgtatagaattttccgcttgtagcattatgtgcccaaaatgttctggatttcggagtacttcagattttggatttttgaattaaggatgctctacatggataacatataatttactattttagccttttttggttcgagatggaatctcactgtcacccaggctggagtgctgtggcacaatctcggctcactgcaacctccacctcccgggttcaagcgattctcctgcctcagcctcctgaggagctgagactacaggtgcccaccaccacgcccggctaatttttttgtatttttagtagagatggggttttgccatgtcggccaggctggtctcaaactcttgactgcaggtgatcagcccaccttggcctcccaaagtgctgggattacaggcatgagacacatctggcctattttaagcatttttaagtttacagtttagtataataaatatacttacactgttgtgcaactattatcaccatccatctccagaactcttttcatcttgcaaaactgaaactttctatccattgaacaataacttcccactctcccctccttcagctcctggaaagcttcattctactttctgcctctatgaatttgataaggaacctcatgtaagtgacatcagacattattcttccttttgtgtctggatcctttcacttggcgcagtgccctcctggtttgtccacgtcgtagcctatgtcagaatttcattcctttttcagggcaagtaatactccactgtatgcatatagcacaattgatccactcatctgtcaatggacccttgaatggctttcaccttttggctgttatgaataatgttgctctgaacatgggtgtacaagtacctgtttgagtcactgtttcaattctttggagtatattcccagaaatggaattggtggatcataaagtcactatttgtaatgttttatttttaggagcccatcctgcacttcctaactcagctattccacagaaggggttagcctgggtctgcatcccagccctaccatttattaggaggtcactttgcctctcatgcctcagtttcctcatctgtcaaagagaactcacctctaagtgatgctgtaagcacagctataaatgaggcaaaataaagccatacagcctgattgtggaggagttcatgtggtgtgactccgcggacctcgcccatcacacttgaacttgtaactaatcacatggctggagagtgtttaacagggacctgatcctgaggactatagcgattgtggttttgtttttgtcttttttaaattcgtaagacgggatctcgctctgttgcccaggctggagtgcagtggtgtgatcatggctcactgcagtctcaaactccaggctcaagagatcctcctaccttagcctgctgagtagctgggactagaggcatgaacaccacacctggctaattaaatatatatttgtagagaccaggtctccctatgctgctcaggctggtctcaaactcatgagctcaaatgatcctccctcttcagcctccagagtagctgggaccagaggcatgcatcccatgtccatctaatttttttagaaaaattatctgtaggctggctgtggtggctcacgcctgtaatcccagcactttgggaggctgaggtgggtggatcacaaggtcaagagtttgagaccagcctgaccaacatggtgaaaccccgtttctactaaaaatgcaaaagcaggtggataacaaggtcaagagtttgagaccagcctgaccaatatggtgaaaccctgtctctactaaaaatgcaaaaatgagctgggcatggtggtgcacgcctataatcccagctactcaggaggctgaggcaggagaattgcttgaacccaggaggcggaggttgcagtgagccaagatcacaccattgcactccagcctgggtgacaaaatgagactccatcttaaaaaaaaaattatttgtagagataaggtctccctatgttgcccaggttggtcttgaactcctgggctcaagtgatcttcccccttcagcctcccagtgctgggattacaggtgtgagccaccttgcccagtgtgttcttaaatgcgatgtcagagttacccaagagaggattcacatgctgctcacatcgaatggcattgagtcaggggggactgtgaatcttttttcaattcttacccacctctcctgaataccctaccagcaaactctcaggtcaatgcaaacaaatcttcagcagcactcccctactgaacttccttttccaaaaagcagaatcctgcccccagaactggcatctccagcaggtaacaggagtgcccggctagcactgaatgccattgtttttgtttcactgatttcttcgcattgttgctgtctcctcatggcaagtgacagcaagatttccacttatggccatgatgcaaaattacttttaaaataaaatgtgcttacataaaaataaaggcgagtctattgcagtaaaaatactacaagaataatatggcaggtggaatgtggatatggcagaattgtgaaggctggagggatgcgaaggaagcttggggaatgttaattaggctccatgagctttgcttccaaactaggatgtgctgagtttgttaaacaaatgagaggaggtaaaggcaaagggcagggggatactcaagcagccccatccatcctgcaaggacccaaaggtccagacaatgttttgatctttctggatgagggctcccacttgctttaggggcccaggagggtttgtcaggagtctcctggggtgggcttttgggacagcacctccctgctagagagacagaagtctgtggagaaacactgtccttttgattcttactctaatttgttgagtacttaacattcatgtggttctttcactcatgaggcttttacctcttgtaacaatgctgcaaatgaaaattatccccatttatagataatcatcccaggctcagagagggtgaggaacttgcccaaggtcacagagccaagaggtggagaagaaattaggatacgcactgttctgacgtcaaataccatgctctatgaccaggctttggctagcaagaatctggcatcctcatcttcactcaggctcccatgctaagcttgatgggaaccaaagcctcatgttctcagaatggcttcaaaactatcgtctcccctagagcaagatttctcaaccttggcactattgatatttgaggccagataattccttgttgtggaggggactgtcctgcgcactgtaggatgtttagcagcatcgctggatctacccactaggtgccagtagcactcacctagttgtgacaaaacctaaaatgtctccattcattgatgtgtgtccccctggtgggggatagggcgtggagaggcaaaatttgctcccagttgagaaccactgttctaggacaagctctctagatgtggtctctgatgagcagcatcagcaacacctgggaatttgttagcaatgtaagtttcagccccaaccccaaaccttctgaatcagaaactctgggtgtgggagacaaggactctgtgttgtaagaagctctccaggtgattgtgatacaggctcatgtttgcctaggccagtggttcttaaccctggctgcacatttaaaatcatctgaacatcttttttttagaaaaacatcttcatgcctcggccccaccccaataaattctaacttaattagtttggtgggcgcaagtattgggactcttttgaaactccccctgtgattctgacatgcagtcagggttgagaaccacattttggacaccttttcttttcttttcaaccatcttttaaaaaacgcatctctcgaggtggaaagaattttacccaaacatatctttggctgttgcctcaaatgctcatggccactcactccaccagagactgaaggctacctcattcattatttttctcccactctgagaaaatgtctccctccacccccgaccaagcactcaggacattttcctgctcactgacttcccccgaccccattcaagtctggagttattaaagaacagcccatgactgaaccgtcttattgattttattgttcagagccctgggatattctaatgatatactgctcaataaatggaaactggtgggatagatattgacggtgtatggtacatttcactgcaattcactgggtcccagtcacttggcctgtaacatatcatctgtgaaaacgctgcgctgtggcctgcaagctcttatccatcctgctgatgttaccttttctgtgcatcaaggatgaaagagctattatgataatagcaatgtggccactgtgtgccaggtcctgggctgagcattttctaacagacttgatatggtttggatctgtgtccccaaccaaatctcatgttgaatggtaacccacagtgttggaggtgggacctggtgggaggtgactggatcatgggggtggatccttcatgaatggtttagcaccattcctttgatgctgttctctagagatctgcgtgtttaaaagtgtgtggcacctcccctgtcttgctcttgttccggccctgtaagacatacctacatccccctttaccttccaccacaattgtaagtttcctggggcctcctcagaagcagaagccttgatgtttcctgtacagctcacagaactgagagccaattaaaactcctttctttataaattatccactcaggtatttctttatagcaatgggagaatgaaccaatacaagaccttacctcatttactcctcacagcagacctttgagggaggcattctgactattcccattttacagataaggaaataaagactctgagtagttacctgacctggtcagctaatatgctgcagaactgggattcaaccctccatctgtcagacactaaaatggggacttttaacccctgagcttctattgtattggaacaacctttcttttcttttcttttttttttgagactgagtctcgcactgtcgcccaggctggagtgcagtagtgaggtctctgctcactgcaacctccgcctcctgggttcaagcgattctcctgtctcagcctcccgagtacctgggattacaggtgcccacccccatgcccggctaattttttgtatttttagtagagacagttttcactatgttggccaggctggtcttgaacccctgaccttgtgattcgcccgcctcagcctcccaaagtgctgggattacaggcatgatctgccgcacctagccatttgagcaacctttcagagggtttcagcacagatcaatatttcacagatcctcctcccttctcaagcagtatttctcaacagggactactgtcacttgggaagagacaattctttgagtggtattatcccatgattacagggcatttgaaatccctagtccccataacagcctctcctcacttgcatttcccagtgccccctaggggaccagcatggtttgagaaccactcatctccctgggaggcagaaggcttcctgccaagatggcctcccactttttggcaaacacaggtagccactctggaaaggctacatagcagagtggaaagaagtttcgttttgaaatcggacagatctgcattcaaaccatggctcttcccccattaactctgggaggtcgggcaagctatataacctctcaaagattctagctcatcatcagtaaaatagggatacatattgaccctccttcatagggaggaactgatggatggaattatgctcagagaagtgcctagtacagagcagtagctctgaacctggggcattatgtctttcccctgtctcctatgtgctctttccaaactcctgatccatagaatccaagagcataacaagtgatggtgttttacgccactaagtttgggggggtttgctacccagcagaagtaactggaacgaatgtctatgatatgccaggcaggcaccattctgggagtgaaaaatagactcatgcacacgccacaagagcttttgcttatgagaagcagcctctcctgagaaagaagacagataataaacacataaatatctccaggaccagtatgtggtatgcagaaaatgaaatggtggccatcattattgttgccttaaataatgatttgcaaatgactacattttctcttctcctctttccaacctcatttccctctatgctcctccaatcaccctttctgtgaagccaaaatgttgtttaatctcacgaaacctctgcttctgtttctcgatgctgaggtatcctttccttttccaaagacaggatttgctaggactgaatcgtgtcccccgaaaattaatatgttgaaggcctagcctctcctgtgaccgtattggagatgtggcctttaaggaggtgattaaagttaaatgaagttgggccgagtgtggcggctcatgcctgtaatcccagcactttgggaggccgaagtgggtgggtcacttgaagtcaggagttgaagaccagcctggccaatatggtaaaaacttgtctctattaaaaatacaaaaattagccaggcatggtggtaggcacctgtaatcccagctactcaggaggctgaggcaggagaatcacttgaacccaggaggcagacgttgcaccactgcactccagcacgggtggcaaaacaagactgcctctgaaataaacaaacaaacaaaaaggttaaatgaagtcctaagggtggagccttgaatttaggggatttttgctcttagaagagacactggagagcttgctatttctctgccacatgaggtcacagtgagaagtcggccatctgcaagccaggaagagggccctcactagaacccaaccatgctggcaccctgatctcagattcatagcttccaaaatggagacaaatatttgttttttaagccacctggtctatggtaattttttttaaatgatagcccaggcagactaatatacaactcaaggaggccagggatgtgccccttagactacaattgacaggttgagtgaggagttaactaggtaagagaagagggaaaagtgtccctaagtggagggaacagcatatgcaaagggcctgtcacgaatgatagtatggtaaggagaagacatacaggaaggccagtgtggctggaactgaggccaagaggaagtgcagaagatgaggatgggccgacagcagaggcatcacacagggtcttgggtaccaccttaaggactgcaattgaagagagtaacaagccctttcatcaggcttgttatccatggttgaggagtgggtggcaggcaggacacattttgaaattcccagatggggtggtgtgggatgccttgcttcatggggtggaaagacaggcaggggcccccatatcctgcactctgtgcttcgtgtgtccagaaagcctgctctatctgtactccctgccctcttgacccagaggctgctgtgtgcaagttctcctacgagccttcctgtcgcttgacattttcatctctgccctcgtttctcctctcttgaagggactcgcaggctcaataaatactgccatggaaaaacgcagcgactcatctatttttattacaaatggagcctctcgaggagggaacaactcttatttacttctcagagggagggttttgacaacaggtttattttctccaactctccaaggattaagtgagtaacactctaaagttaacagtacattaattaatgccaaattggttggaattttcctaataaaaatcctcatagtaatcacattatgggccattaacgctgcctcctgatcataaaccataaatatgttctgcaggtgccttcttttaaaaaagggacatttctccaaatcgtttcccatttgtcacattaatgctgtcacgtcacataatgcagacaggaataattataaaagctcatgtgggtaggatttactttgcgctggtcactcggccaagccctgtacacatatcatctcattgagttcttgcagcaaacctatgaggtcctgctatcattctcattttacacatggggaaactgaggcagacagaaagagtgtaatctgcccatgatcaaatgctagcaagtaatggagctaggatgtgagtccaagcaaactgattccaggatactctgtcatcctgcctcttgaaatataaggactacatctctaagcacagtggtcctcttcgtcaagcctactgctaatgaaatctccggttgatcacaacagcaacgagcagcaatagtcaacacaacatttggttttgctcctagagggcagggatggtgtttcatttacttggcctaggagagtgtctggtgacaatgccaggagcacttggaacatacagtaaattcctgttgaataaatggacatagaaacacacatgcaacagggttcacaacagtgggtaacaacgagcacctcaaatgcactgggatctcaatagatccctctccctgcaatgatgtgagctgggctcagcctcaggccggggctctgatacacagacaaggagaccacaccacttggggagctgcagttcctgggagaaaaccaaggaggacctcgtttcgaactctgttctagcttcacttcttaggtgcttctgattgtttcttggatttctctgtctacaaagataatacttactgtagaaaattcaagcatacagaacaatatgaagtaaaaaaaaacccagatattagtgccaaaatatcaccattgttaacaaacgttcagtgaacattttgcaaatagttttatgcactcacgttatatataatcatgtatgttctgctttgtcatatgcattctgttttcagtaatgtactcctgacatcttttcactgtcagtgaatacaggcattctctctttccttcctcccaccctcctccttcccttctcaaatgttcacagagcagctacgctgccaggcactgagaatgcccaaatgaacaaaaccagtgttgaatctgtattcaaggagctgacagtccagtggatgttggatggagaaaacagatcaacgtattttacaaaaggtgttggatgcaatgaatgaaaagtacgggcggccaggggaggagagagatggggccaggtgatctgatgcaaaccaggtctatagacctttccaaagaagccacggtgaagctgagctgtgaaacataaagagtgagccaggtgaaaggatgtcactttggaaggaaggaagaccatgtgtcaaggtctcaaggcagggagggtcttattttgaataataataataataaaaaaaaaaaaagacaaaaaacgttgggggtccaggcgcagcggttcacgcctgtaatcccagcactttgagaggtggatcacaaggtcaggtgttcgagaccagcctggccaacatggtgaaacctcatctctactaaaaatacaaaaattagccaggcatggtggtgcgcgcctgtagtttcagctactcgggaggctgaggcaggagaactgcttgaacccagggggtggaggttgcagtgagccaaaatcacaccactgcgctccagcctagtgacagagtgaggcttcctctcaagaaaaggcaaaacaccaaaaaaacaaacaacaacaacaagaacaacaaaacaaagcgaaaaagcaaactcaggggtggggagaggggagtagtgcggacttttgtttttttttttactttcctttggtgcttttctgtatttttaagacttctgtagggtaatgacaagaacttactgagtaagtaattcagggccactgggtattttttcttagatgcctccaaagatggaaggctcagtgccttacatagcagggcttgtgctcagcagtgattgtgagctatcgcttccaaaatgtgcctgctcgaagctttcatccataggtcctaatttggtcttcaaagatagtgctgctgcttctctggcaaaccaacctctcaaatatgtggaaattgttattttgctattactccggcccccatctccctccaaatctaagccacctgcatattccaagctcattcaatttctctcctacaacatgtaaggtctctttgtcatgtttcttcctgggagtgactagaagatcctccacgggcacagcctgagatcactgtaaaaactttgaaatacctcccaagcatgtgccagcacaaagtcatttgttcatttgatgaataattataaatgcctgtgagtgtgctataccctggggcagtggcagggggcagggtgtgaggtggagggggaagacagcagtggacaggatggacttatcacttatttgagaaataattatcggcagggcatggtggctcatgcctgtaatcccagcacttttggaggccaaggtgggtggatcacctgaggtcaagagttcaagaccatcctggccaacatggtaaaaccctgtatctactaaaaatacaaaaattagctgggcgtggtggcacatgcctataatcccagctactgaggaggctgaggcacaagaattgcttgaaccaggaggtggaggctgcagtgtgctgaggtcgtgccactgtgctccagcctgggcgactaagcaagactttgtctcaaaaaaaaaaaaaaaaaaaaagaaaaagaaaaaaaaagagaaataattatcaaatgcctgctactgggtgacacactgcagggctgcacactggaccagatggacatgataggcgaatctctaaataaatgtgaaatgaatgaacgctacatcttgtcttttaccattacagcatcattgaggggataaccattatgctgtcttggtgcttgtattaatcgagtcaagttccctaacattggtttgagagctccaggcaggtcactcttcgacctacctggaagaccagagagaccctgatttctcaacgatggcttggaaacttcatttaagccagggggctcctgagaatacttttcttttctttctttctctttttgagatggagtctcactctgtcacccaggctggagtgcagtggtgcgatcttggctcactgcaacctctgcctctgggttcaagtgattctcctgtgcagtggctcacgcctgtaattccagcattttgggaggccgaggcgggtggatcatttgaggtcaggagttcgagaccagcctgatcaacatggtgaaactccgtctctactagaaatacaaaaaaattagcagggcgtggtggtgcatgcctgtagtcccagctacttgggaggctgaggcaggagaataaacttttctaaataagaacctctctgaatgaactgacagaggaagctcattttaaacatgagctggcccctagaccagagaactgcaggggaaagtgggtgggtcctaggattttttgacaggatgcagttaagataagcctttaaggagacagaacgtgtgctaccacagcttgggaaggccactgacagtgaaaacaatttaaattaaattaaatttagtcagctccaaaaggaaacacatgtaatgttaatttcatgggtgtaccaatgtgtaaacctaacagatgatacttaaatgagaaaggcagagaaatgacatttggttaaacaatgcatcagtgggtaggatttgttgaaactgccatttaaaaaaaaaatatgagcacaattgaaatctgagcaagctgtcacccaggccaggccacctaggcgttctcatataacacacttgagagaagcagtgggtagccgggattggaggcagtctggataaatttggggaactcaggtcaatgtctgtgttaactttttgtttttgtttttgagacgtagtcccactctgtcccccaggctggagtgcaatgccgcaatctcggctcactgcaacccctgcctcctgggttcaagcgattctcctgcctcagcctcccgagtagctgggattacaggtgtgtgccaccacactcggctactttttatatctttagtagagatgggatttcaccatgttggccaggctggtctcaaactcctgatctcaggtgagtcacccgcctcggcctctcaaagtgttgggataacaggtgtgagccaccacgttcggcctgtgttaacttctgatgctcttcctgggcttgtttgcctgggcagataaaatcatttgcttgtctctccaactatgactgagatctcaccctgggcagaaagtgcgcctttgcttgtttatgtccttttcttaaaagcaacagattgtgtagtattggaggtacatgaaaatgtggaaagattggctttctgttttatctctgtcccttggcacaaaataggcactagggcaataaatgcagaatgagtgagtgatccagacactccttggccatgttttccacccttacggcttcatggtggcaacaacatttccttgcctcttgttaataatcatcacctcctaacatattgtttggggtcctcgtccctctccggcagccatcactccttttcaatattcacagaaccatgtcctatagtcaataaagctacgggaagctgactgattggcaaaaaacaggtctctactaaaaatgctaaccccagaaacaatgcatacacactgaccctgccagaaatatattgacaaaagccagcatttttttaagcacttactatatgccgggcatggtatcaagagtgttttcggttggttggttggttggtggcaatttttccagttcatcgtctcaaaacactgagacagatgccatcattatcccacttttgccaaggaagaacaggttgagactcaagaggttatatagcataaccaagatcacacagctagtggccaagctgggatctgaacccagactaacctgcttccaaagccattactccaacctgccttaaatgtattaagaatatgttttaagcagagtgtggtggggtgcacctgtagtcccagctcttcgggaggctgaggcaggaggatcgcttgagcctgggaggttaaggctgcagtgagctatgatcacgccactgtactctaacctgggcaacagagtgagaccttgtctccaagaaaaaataaaaagaacaggtttcagatgacttataagagaggaagttgacagttcctttgtgctttacatagagcactaaaatccagtatgagccagggcaatgctgggctcaacacatggatcccaaaatcgcagtggcttgaacccaacaaaggcttatttcctgctcctatgcagcttgagcagctctcctacagggccgtcctccaagaggtgacttgaggatccaaattgcttcaactacacaatcccactccttagcacccttctcttgcagtgcacagagaggacagcgattggcatgacaaattcacagcccgtcaactggcttggccaagaagtaaccatcatttccactcacgttcctctgagggagactgaatcctaggacccgacccagatacctgggagttagtaatggagagaagaacatgggtcctagaggaacatttatattttatgtcacagaaacatactaagttatgccctaagccagcacttcttgaccagggacaattttgtctccctgaggacatctagcaatgtctggagacatttttatttgtcacaactggaagaaagaatgctactggcacctaggaggtagaagccagggataccgctaaacgtcccaccatgtacgggacggcccccacagaagggattatctggttcaaaatgtcaaatgccaaggttgagaaactgcttgaaacccgtgatcctgaaaaagattgtctgaggagcttattaaaatgcagaatctagaccgggcgcagtggcttacgcctgtaatcccagcactttgggaggtggaggcgggtggatcacttgacgtcacgagttcaagatcagcctggccaaaatgacgaaaccccatctctactaaaaatataaaaattagatgggcacagtggtgtacacccataatcccagctacttgggaggctgaggcatgagaatcaattgaacccgggaggcagagattgcagcgagccgggatcgtgccacagcactccagcctgggtgacagagcaaaactctgtctcaaaaaaaaaaaaaaaaaaaaaagaatcctgcattcctccctccagatcaccaccctggcagtatttcagtattttcaggggccctctggcaactgtgacggccgctcttcgtgaaccacactcagggaaacctcacaggaaagaggaatcaagaacaccaagcgggggctgggactaggcgctgatgaactcacacagagacacccctcaaatgcttcagggtcagtgtgaggcaactgcgccaggaaaaaaaaaaaaaaaagaaaggctgacatttgttaagtgcctctctctgtctctttcgtgcaagccttgaattgcagggaacatattctaagactaacctgtcagccagtaacaactaaattactaaccttgcctcccgctgtgccccgtatccctgtcagatgcacagtcgcactcacagaggaatgcttcctggagatgtgttcccagcattggggaagctgacccttttgcaggaacagagccacgtggtcacatgtatttcacaggggccagggggctggaaataacccaaaggaaagggaagcaactctgggcagagcagtagggcaatcagagtggttgaggctcttggtcaaaaccacgtctgctttattcatggcactcactacaacctacttcacatcgtttgcagtcaggtcttgccaagaggctgtgctttagccaataaaatagaaatgtgatgcacacaacttctaggcttacccatggacacctgtgcatgcttctctgtgctatttccctcttcactgtctgggtgcagaagagcacggtgaccttggatgctgtgtgttgaagatagtggagatagtggagtcagatggaaagggcctggatccctgaattacaacatggaggggagtcaatcaggaacatctattttggatggcagaggatgaagacatcaaccatcttcatgttagagacattatacactggtggctgtgttccaataaaatttgacttacaaaacaggtggtgggctggattcagcccactggctacagtttacccatctctggttgaagagaagctctatctaccaaataaagtactagtcttccagaaagagttatctgattagacagtttgccctgtgtgacctcaacgcaaacaaacattgctacgtttgattgttatagcagctgatgttccctaactaatatagtgattctatacctggttactgaaggcagaaaggcttgggttcaaattctaggaccagacctcgctagctctgttatctagagaagctaccagaacctttgagcttcaatttcccaaagtggaaaatggaaaggaaatactgaagaaggtaacctgacatattttaattgaaggctgtggtatattggtcatctaggagctgttgtacagatgttctgattgttgaccacattctatcagcgacaagacggacaggaggaaaagcaaggcattgagatgggtgaaggtgaaccatttacaaagcctaaactttccatacatttcttacatgaacaaatgaatgacccaacgaacacttttagcagcatctgccttctatgaagaccaggcacgtgcatgcctaatcaccctttgggggcaagagccatctgtgatttggcttgttttctttcacagtcttatttcgcagtcttatcagtgtatctgtgcaaaagattactcagtgtacgtgcacttgttagcagatgcagggaagctatcacaatttagaaagcacgtgctttatactttcaagtcaggcttccctctgcgtcctggctctgtcacttatttgatctgtggtcttgggcaaatggcttcatgaactcttgaagcctcctcagcttccaaatctgcaaaaggggtatgccagagacagctaaccatccatcaacatccattttcccctctgttatacacaattacaaatgagaatgtgacacttatcaacatttcttcaacacttctcagcctctcttgtagcgaggtgcatgaggctctccctagattttaagacaggaatcttaaatattttattttctataagaggacagacagtaaacactttgggctttgtgggccatatggttctctgttgcaacttctcaactctgccactgtagagagaaggcagccacagacaagaccaaaacaaatgagtgtggctgtgttccaataaaacttaacttacgcaacaggtggtgggccggatttggcttgtgggctatcatttgccagtccctggtttaacagatgctcagcctaccaaatatagtattagtcttccaggaagagtcatctgattagacattttgtcctgtgtgacctcgtaagccaccaattcttattttacacacacacacacacacacacacactctctctctctctatttataattggtctgtgtctctgaaattctcatcatgttctgaaacgtcaactgtttcctgatctttaatcccagtctccatgggccatgtccctctccctttcctcctcctttttaggaccaactccataatttgcagggctcactacagatgaaaatgcaaggccccttgttcaaaaaatattaagagtgtcaagacggtgaaagcaaagcataaaatctaacatggggctttctgagcatgagctcaggttacaaagtccaccaagcagaccctgctggtctggcttgtattaccatcagcaaacccagaaagttttctgcctaatttcttgacaagtccagaaacttgccacctgcgagctgcttgaagcgtttcaggaatggttttgcacatcacaagaagaaggaggaaaaaaaaaaaacccaattttcttttagtatattacttgttagacagcgaaatggaatataattatggtgtgacatttccaacagcaaatatgttccagtgtaagcaattaacaccggttcttttggcaggcttaaaaagattactcagagactgtggtaagttacaatgccccatgaatcataaataatgtagaatcgcagctaagttgcattctacgaccaaagttcaaatttcttgatgaaaataaattgggtgcttttaaccctctgttgacttcatgtggcttaagcagattcggatcataagttctttggatttttgtaaattacatatttaccttacccctaagaacatctgcaaaaaattataaaaaaaaatctgcatgtattcatttcagctgctggaaatttgcatgaggtagtgggtttgaaggggacccctccaggatggacagaatgggggagacggcttacactgagaactattatccttggaggctgttatggttaaatgatgaagtcccaagatttagtagaaggcatatctggacctatgtccctattctctctgccattcttgacacaaccaaagggaaggcagcaccttctgaatgtatttgtgcagcttgtgactctgagcaactgaaaccaatgaaacaccagcagcagttacagagccacataccgtagggacattcaaggccaccgttacattcaaagcctcagggccgtagtacccttgtactatagcactactagcactatgggctggataactctctattggaggtgacagcaagctgtcctgtgcattgtgcagtgcccaggagcatctctggactcgatccactaaatgccaggagcatcctttctttagttgtgaccattaaaaatgtttccagcaggcacagtggctcacacctgtaatcccagcactttgggaggctgaggcgggcagatcacctgaggtcaggtgtttgagacaagcctggccaacgtggcgaaaccctgtctctactaaaatacaaaaattagccaggtgtggtggtggtggtagtgccagctactcaggaggctgaggtgggaggatggcttgagcccaggaggcagagattgcagtgagccgagatcacaccactgtactccagcctggatgacagagtgaaaccctgtctcaaaaaataaaaacgaagtttccagatattgccaaatgtccctggaaaaaaaaatactactttagatagacctgggtccatcactgtgtggccttgagcaaatgacttcattgctttgagcctcagtttccacatgtgcaaaaaaactcccatgcctaccttacagagagattgtgaggctgggatacaatgatgcagatagagcgcttagcctggtgtctggcataaagcaagcattcagtaagacagatgctatttattccatcacccatttgattgtttacaaacagctcctgagcacagtggagccatggcaggtaccaggggtgtgaagacgcataagccttatctctgtctcagacatgctaaccaacaacgtcagtgcaagggggtgctccctaaaatgaacacctggtcatggggcaatgggggcttggagaaaaatacctaaatctcgagacttcatggacaggatggcacctgagtaaagtaaaagttttccaggcagacacacttggggaagggcattccacacagaggcaactgcatgtgcaaaggtatggtggtatgagtcactcagaactcccctgagctcaggacggctgggaggtgaattctacaatgcaggtaagggaggaggagcagcaggaacaaggctggcaggcagagggcagatgaggaaggatcctgagatgtcaaatagttctcatctctcttgtcaacccaatgaactcatagcaaagctgagtccaaatcctgccttgcaggacgcaatgcagtgattgattagcaatgtctgctttggcccaggaaggtagaagaggctcaagctgcaatgtatttccttgtttgatgagggttttcatcaggggagtgatgtgaggagaagcacattttttaaagctcactctggaagccatgtttttttgtttttgtttttgaagagaagacagaggcagaaatggagcaggagaaagagttgggaagtgactgtaatactaccagacagagacaatacatgcctaaagggcagagcaggaggctggggaggaggagacagatacaaggtatttaggacctagaaatgatagcgactttgtggatttaagggagtagaaataacagagactcttggatttttggtttgggcaacttggggaataacagggttattcacctaggaaaaaagttcaggagattttggaggcagaaggatggtaggttatttttcagacccttagctcgtggaaccccaaggtagaaatgtccattgactgttgtaggtttggatcaggaacccagaccagtgatgaggaatagagtcattgcttagatatggcggctgtcttcactggccaataagtgagctacagtgaccctgcttctccagcccctggggaagcccaactgtaaatgagaaagacagctccttccagtgggattctttcctaatctaaaggcattcccgattgacaggattagtgaaggacgacagaagaaagtcattactgaataatcccctgcacatttcatagtcaacacagcattcatatgatccttgtaatccaattaggtgatgcaggaagctatatcttaattcctgacttcattgtgacttgcctggtcacaggcaaaccttgtttaataaggtgtcacctaaacactgagtggtgcatacaaaatgggcacagaacggtgatggggttgggggctgaggggaggaggtgactgctgttgagaatatgtcctgtctcaagcagccaataggggacttagaagctccatgtcctcatcagcgaggcttgtgattggaggaggcttgtgattggaggaggcttctgatcggtggaggcttgtgattggagaaggcttctgattggaggcagcttcatctccccttctctccatccattttgctcctccggacctgtgtgtgacaactgtctgtctggtggctggaactcatctgacaataggaacaacaatcatttttacatgattgctacttactgagggcccacttcatacctggcattttacacacctggcccaaaacacccttgggcagagtagattgtatcctcattctaaggatgagaaaactgtgactcagagagattaaggcatttgtctcaggccacacagctagagttacagctgggattcaaatccagatctgtttgatttccttttatttttattttttgagacacagtctcactcttttgcccaggctggagtgcagtggcacaatctcggctcactgcagcctccacctcccaggctcaagcaattctcctgcctcagcctcccaagtagctgggattaccaatgagtgccaccaagcccggctaatttttgtattttttgtacagatctgtttggtttctcaagttagtgtcattcgcctctggcaccatgcccttctgaggtgagattccagaactgacgtgcaaaaaatgtgcaaaaggcctcctgaactgtagcccgggccagtcctggcccgcatgtccatgtgagggctggtttgcctccatcctccttgtgcatgtgaccccagctgtgggcttatgtggaccggatgaatgtgactgtagttacacctagatcacaaacaacatctgagaggaggtgatgcctctgatctctatcagaccacgaggaaactagagagtatggagtctactccaagtgctgggctaggccccagccttatggcttatgctgggatctcaaattccaggccacactgggctacccatgtaaggtcaatgagagaagtaggccaggtgggggcagaggcaaattagaacaagcccattcaccctaacagaggtgatccattctcagcgccaatcattttaccatggggaatgcattccaagttgctcagtcttctggttttccagaagactccagaaatacttattcttatgggcattatcccaattttaaaatggttacaaattcacatttgtaaaaaaataagctgtatgtgagtgtactgggttaaacggcatccctccaaaatcatgtccactcagaatctcagaatgtgatcttatttagaaatacagtctctgcagatataattagttaaattaagatgagttcatactgggttagaatgggctagaaatccaatgactcatcttctcctaaggccatgtgaagacatgcaggaaggtcacgtgctgatagaggcagggactgcactggtgcatctacaagccaagaaacaccaaggaacgccagcagcaactggaacctaggagagagccatggatgcttctccagatcctctagaaccaaccaaccctgctcatgccttgagtgtggacttctgacctccagaactctcattctccaggacgagagaataaattcatgttgttttaagccacgctggttgaagcgatttgttatggtggccgtagggaactaaaacaaagagccaaacccaccagggctgcgagaggaatgtgcccaactgtccttcccatgatcacaggatcatgctcttgatcctgtccctgtccacctcctcgtctgaagcttgactgattcactttctcccttgcattgctgcctgtccactatgctggcctccatccttcctgggctagttccgatgtccccattttaacagcatttcctgatattggccactctaagccttccgtgagcagtagatggtcctgctctgcaccctgaaatctgcctgctgtctgtcagtcaactggagttgttttccaaaggaagctgatgagaaaatccaaaggcttgtcttcatccattctccgtttttcttccagagcttccaacagctggaggccgcctcctctttttggaataccctgctcttttggcagccctggtcctgcccttccaaggtcatctgagcacctttcatcacttcccttggctccgtgatagccttttctttcatcctccggtcccttcaatgtaggcatttcaggcctattctcttctctatgctttaaataagctaactcagtggccctcaactggaagtgatatagccccctagatacatctatcaatatctggagacatttttcattgccacaactgggtgaccctgtactaccggcacctagtaagtcgaggccaaaggcatccaaggggcacaggatagcacctgacaataaagaatgatccagcccaaagtgtcaacaggaccacagttgaaaaaccctgagctaacagaatcccactttgatgctcttgatcatttatctcatgacttgtgcctctcaaggaactctagtcttgaatgtgttcagaaggaaacagttcacgcattgcttcttggagatttccaatgtgcatttgcccttgaaaggctctgacaaggtctgcagccaaataaaaacttgctttgcatttgtttaatccaccatttcctaatgtatttgaatacagaaatcctttgtttaggcaataatcactatcattcttctgaagtaagctgcagtatctaacaatttattgagcatttaccatgttctagagtgtcctaagcacttcacacatcctacagggcctttctccccacaggcagtggggggcagtggggtgcagtggataacagtgttggctctggagtcaggtagctggcttggaatttgcagccacatcagttgagctgtgtgaccttcataaatgccttcatttctctaagcctcaatttccttacctttaagtgagggtacagccatgcatcacaacgatgggatacattccgaggagtggattgttatgagattttgttgctgtgagactatcacagagcgcagttacacaaacctacatggggtggcttagcacatacctaggttatatgctcctaggctacaaacctggacagcatcatactgtactcaatactgtaggcaactttaacacaattttaagtatttgtgcatctaagcatatctaaacatagaaaaggtacagtaacaatatggtataaaagataaaaatggtacacctatataagatacttatcatgaatggagcttgcagaactggtagttgctctgggtgagtcagtaagtcgtgggtgaatatgaaggtgtaggacattactgtacattactgtagactttataaacactgtacacttaggccacactcaatttataaaaaaataaactatgatgttatgactacaatgtaactagtccataggaatttttcagcccctataatagggctgaatagtcaacgatggactgcacatacaatggtggtcccgtaagatattataatcttattataataatctattattatatataatcgataattatatatattataatatataatagataatagattataatcgattatatataatatattatacaatatatactatatataaaatatataatatatattatatatacaccttcatatttgattatatgtaatatattatatataattattattataatctattataataagattataatatctatatctataatagatattatactcttatgggaccaccattgtatatgcagtccaccgttgactgaaacactgaaacatacagtgcatgactgtgtctgtgtgtctgtgtctgtgtgtgtgtgtgtgtgtgtgtgtatatatatatatatatatacatatatatatatatattgcccatgtcaaaaagttctgaatctcaaattagataaaacttgcaaagggctttatggtatgttctcagtaatgttgattattgattgattgatgatgatgaagatggcggtggtgttggcagtgatggtggtggaggtgatggtgatagctgtgatgactgtgaaggcgatgacagtggtggtgatggggataacaggatggtggtgaaagagataataaggtggtggtgatggtgattctgatgggggcggcagtggtagaggtgatagtggtgttggcaatggtggtagtgatgaagatggtgatgatatgaggtggcggccttcgtcatggtgttggtgataatgttggcagcggtggtgatggtggtattgtactctctatttggactgtccttcttgacctggtgaaattatatactcgcctacttatttatctcaaagactacgacgttttcactgattgccccctttgggcataattcttcctcttttgtgtcatatttttttaatgcctccaccatatcactctctgacatacactatcaggacttgtctcctctgctcttcagggggcaccttcccttcacctgccacatacaaagaggggccgtttaataaatgcatgttgacatcaaatagggtggattatggggcaccagaaccttccaacaagcctctccccaactccacaggaaaaatgacaacagaaagcaactcgatgagaattttgcatcccctgccggcttcaaggagacctcaaggcaaactcatgcccagcctcaaaacactcagaaaatgggaggtggcaccagaagacaagtttcattgcaggccaggcactgcccatcctgcttgaaaacagtgagtgatggatgccagtgctgagcaaagcaaaaggagggcctggaaaggaagcagcctggtttcccgctgcaagctagtgatggagacttctgactgcggaagcgagcaagagtcctcagagcagaaatttaagtaggaaggtgtggtgcagggctctgcgcatactaagcggcctgcagacgcgccctgcttcaaagcagagattgcaggctgccagctcctgggcctgcccagcctgcagacagcttttcttgggctcacactctgttgtgctgctttgttttaaattaaaatagttgtcagttaaatcaagagatttcagattaaaactcagatttcttacaaaaagaataataattggaagagtgagcaagcaagcctgggcctgcagttctcaaggcaagggagcctggggctttacactatcgtggagctaagtgagtggcagcttctacctgcctactccaggcattgacatcctgcctggccccttggggtattttgtgacgcttgctataaataccaccagtgtatgaaatgccaacttcatcctggttaagcgcacgtgcttgggggtgcggcagacttggcttcacatcttggctctgattttgcgtagctgggtgatttcaggcaaggttacttgctctccctaagtcctagtttcctcatgggccaagcaaaggatgctaatgacatggctcctccatactgaaggattcaagaagaccggacctaagacacacttatggagtgattctcataactggtacctgtgtcaacagtgaggcgggtactgctgccacgcccattttgcagaggaaaaaccttagactggagggatgaagtgatttgcccaagaatgcctagcttgtgagtgacagagcctggattcaattgcagaaagcctgccttctgcacccaagtcatcaccacttccaactctagatgtttcactcccaagtggcaaaatcatccctccatttcagctcttgcaaatctctgggcctacctttatccccgcttaactgttcagttacatctttgcctttccgatgaggctctgatcaacgctaagtcttgagatactaagttctgcacagctatcacccgtttgcctaatgaataatgaataaatacctaataaataaataatgggtaaataagcacataagaaatcaatcaaatcagctagtgggtagagagtagataaaaacaacaacaaaaaactaacagctcattgactactctttttttttttttggcatttctaaaatctctctgggatcattatacatttcacagcagcactcgaagaaccctccccatgtgggaatccagcaaactgagccatgtgataaaataaataaataaataaataaataaaccatcttctctgcaaccctaaggttcaagtctaccctgagcaaagtgaacccagcattccttggtgcacatccacagtaaatgattacttagcccacagagaaatgtctgtctgcaagactgtgttagttattatcctatcataataaaacagattatgctatagtaatgaatacgaccataatggtctgcggcagtttaatcaatgcattcttcaactgcaactgagcaaaataggtaatggaggatcatttgatctacatttttattaatttggtgtcatctgtctcctggttattttaatcatctctcattatgagaaaatgggaaaacttcctgaaaaaaaaaaaagtagagtcatcttgctctattttattcctcgctttgttttagtgtgaaaagtagcttgttccagttcagtttgggaatggaggttactgatgcctgattaaatgtagttctagatttcagagggaaaagctcccttatctcacacaagtcagacaaagctgttcaagtcatacacaagttgagacgtgttgaaagtggcctggaaccactaacagccaaatcatcatcattatcatcttttttttttttttttggagacctactatgtgctgaatgtgctgagcatggtgctgggtgagctcttctctccagtcctcccacccatcctgcaaaaggacgtaccagtatccccatttacaaatggggttcagagaggtcagctaacctggccaaaggtcacacagctggaaagaggcagtggcagactccaaactcgaagggccccgtctcaatgcctctcagtatttcttgtatgcacgaaagggactgtttgtttctcagtccccaaagacgcgctgagtcacggtagaaattatgcattcaggatactgagtggggaattatgacaaatgctttctttgcagttcctttaaggactgtgtctctcttgatatagctttctggcttaaaaaacgtttgcctagtgcctgcatctgtttacagaaaatctgacgtgttggtaaatttgcaccttgagtgtcctccaagtaacagctttagtccaaacccaggttctaagggcaaccatccctagccttttaatcacatacatcactctctattacttaatcattgttattattattattattgagacagagtcttgctctgtagctcaggctggggtgcagtggcccaactgctgctcattgcaacttctatctcccgggttcaagcaattctcctgcctcagcctcccgagtagctgggactacaggagtgcgccaccacacccagctaatttttgtatttttagtagagacggggtttcaccatattggtcaggctggtctggagatgcctttttcatcaacagatcagcatggccatgtgtggccctgaaggcttaaggttgctagatctttccatttatcttgagggaagctggagatcttgaaatttaaatacaagcatctgatttttaattattagcaactaattcagaaaattcaagcatctagcctgggcctggcatcttgctggctttagtctccatgctaagagtgaaagtgagcatgtgtagggtcttaccacctcttcttcctttacgagtctaaatggctatcaggaatcaaagacacatggactttttgttagagggactaaggagtgtcagtatcacaactgaaatggagagtacaaaaaaaaaaaaaaggctggacttggttgaggggacagtgtggaaaaactgatgtgggactgtgacctcagtgggacatcggactggtgatgcccattgtagtttcccggggctgccctaacaaagtcacacagctggggggcttaaacagcagaaacttactgtctcatagtgccggaggctggaggtccaagatccaggcgttggcagggttcgtttcttctgagggctgagaaggaagaatctattccatgcctttcttctggctcctagggaattgccggtaattcatgttccttggccttgagatgcatcacctgtctttacgtccatgttcccttggcattcttctagtgtgcatgtctatctgtgggtctgaacgtcctctttttatacggacacagtcatgttggattagggcacgctctaatgacctcactttaacttgataatttgcaaagaccctatttccaaataaggccacattcacaagtcctggggcttaggaattcaacctattttgggggatacaatgtaatccataatatctacttagcaattgagtataggattctgaaattctgaagagaggcttgatttaggtataattggcatttaggtggctgttcaacgcagaaagtaacgtaaagaacaatgttcaggtgagtcttgtttggggatttaaaagatgaaagattctaaggatgtgtaatatacgaagtttggtgcttctcaaactttaatgtccataaagtagaaatactggtattcaacttacaatcccaattattacattattattatttgaagggctccagaaggagatctgtgtttttcagtattttttccccattctcattccaggaagaagttccaaaatacattagagaaactattaatttttttttccaaatggacttttctcaccccacaagttggcctcccttggggtgactcctgccctctcctctgccttcccacactcagcaatgtgtcttggttgaagatactggttggaggtttaagatcaatgcccttcgtcctgacaggcagtgaactggtttttcagaacctttctcatgactccaggaagtgcacatgtaattaaactgagtctgtgttgggtttcagattagtgaagtgtgcctgtggcaaaaggtctcttccttcctgagagacgcagcggtgtaattagaatccggagacggattcatcagcatttcttaccagcgtttctacaggatgctccaatattcatctgggcctagttctgcttcctgggagaccatgggatgttgttgctggatgccatctgctggcaaaatgcaggggttcctctcgggtcacttgggtgacactgggggttcagtccattccaagcaagttagctgagagcccaggtaaaagtcagtagcaggctggtaagtgtctgtccttatttccaagtcagtattaaaatggtccaggcgtaaggctggctccaaatccctctgaaggtcattgttcatgcattagcagttcagcaaacatttgtagagcatctggtacatgtcaggccattccaccttcacttagcatcctttcggtgagggcagtggtacctggcacacaggctgggggatttttatcatgagctgaagtcagagcactttttcccctggcctttccattcatccaccccatccctaaaagtcaactgaaaccctggagaaacaagttgcagttattccttgttaaatctgtaatttattcccattaatcctttttgaagacaatggcaaatctgtaaaatgttcaaatacacacaggaaatagcaggccggaattttcagcttttgtcttagaacaggagtcagcagacttcttctgtaaagagttagactgtaaatattaggttggtgcaaaagtaattacggtttttgctattgaaagtgatggccaaaagtgcaactacttttgcaccaacctaatagtttaggcttttggagctgcacagtttctgttgcaaccactcagctctgcccttgaggttggaaagtagccacagatgatgcataaatgaatgggcgtggtagtgtttttacaaaagcagactggcagctgtctttggacccaggacccctgtcttagagaaatcaggttttgtgatgctgtcggaccccaataagggaaaactctaaattccctttcatggcctacaaggtcctgcatgaccagatccctgccctcctctttgtcttcagcatctatgcttcttattgctaattaaacttcagctatcccttccgccttctggctcttagtcatgccaagtgtgtggcaactttaggacttttgcaaagctgttctttcagtttcaacggcaccagtggagctggactccatccttttcagtttctcccacttctatcaacttttccaaataagtcgaggagtttacgtgatctcacaatggggtgagatatctcatgatatgaggtagggcagtcatctgctcattttctagatgcagtaatttctccatttcagtcagtgatagcaacaccaatcaggtcctctaatgaacaatccaggtgtcttcttcgattcctccccagcctcatctctacagccaacagactgccaaattctgccaaatttgcctcctgaattgttttcaaatccaacttttcctctttcttaattgaacctattgtcatttcttgcctagactaccccaaaggcatgcttactggactcttcacttgcagacttggacccctgtaattcatccatccatccatccattcatccatccatccattcatctcattcatccatccactcacccacccagtccatccatccatgatccatccatccatccactcatccagtccattcatccatccatccatccatcatccatccatccactcacccagtccatctatccatccattcatcccattcatccatccactcacccacccagtccatccatccatgatccatccatccatctactcatccagtccattcatccatccatccatccatcatccatccatccacccacccagtccatctattcatccatccatccatccatccatccatccatcccattcatccatccactcatccacccagtccatccatccatccactcacctagtccgtccatccatccatccatccatccatgcatcccattcatccatccactcatccgcccagcccatccatccatgttcctagtccattcatccattcatccatccacccatccatccatccacccaccgagtctgtctgtccttccatccatccacccacccagcctgtccatccatccatccaccaaccacccactcgctcagccagtccattcatccatcctttcatctgtctgtccaattcacttatctttttatccatccattaattgactcatcccatccatgttttcatccactcaacccatctttccatatatccacccatcttctcattcatccctccatttatccatccagtgtatctacttagtaccaggtggtgtaagtagtgaaaaaaaatatttagaacctgccctcctggatcttttagtttaatttggaaaagggatgctaaacaaactacacaaatacatgcatattaataaactggaataaatgctataaaagaaaagttttgcctgagaaagcataactgggtttaaactcagatccaaggaactgcatgaattgctgggagaggcatgagaacaggggtatggacaggaagactagcatgtggggaagccttcagctacagtctgctttctctaggggatgcaggaacagggagaatgggtgagaataaagggagataaggttgaagaaggaggtaggccagactgcagtgagtcctgaaggtctcactgacttgcaatggggaaagtccttggcaagtcttcagcagacgagccacacagttccaagtacatcttaagaagcacactctagatgcagaatgaagattcacttgggagaggcagggagcgggtatgagacgcagatgtgagcaggtaagttaggaatgtattgccacaatctacatgacagggatgttgcagaagagacagagagagaaatggacccagcagtgatattcaggatgtagaattggaaggtcttgctgctggttgaaatgtgagaatgagaactaacctttttcaagctcttcgggaccaagcctgaaccagcctcagtggcctgagctttccagaaggaaataatgctttctttaatgatgaggatagtaataagataattagcactgaacaagcacctactctacaagcaccaggtactttattatgtattacacatcattccatttaggagaacctgttggatagatactatcattagccccattttagagacggggaaaaatgaggcacacagaggtttaggtgatgtgctcaatgttccatagctgttggtagacccaggattcaactctagaaccccaatgattagaagcccatgtccttgaccatctggacaggaccatttccagtattccacatttcacaggatcctattccatgtttttggagccagagaactccggcgtagacacccctctgccaccccggagagaaacctcataggattccagacgcataagtaaagtctggaggctgagctccgctgatctgctgcagtctttattgctctacaaatgcattattaatcagccactggggtcctccccatagagccttttaaattacagttaaattccttgatagcgtttcatgcacctaatggtgcagttcctgtgttcacggcaataaacaaggggagagagggaggcctggataaccaggttaattgctctttgaggtttaggctgagaaagcaatggcaacagcacctctaaattctccaggtccctcactgcaatgctaataaagtcttgaaacaaacagcgctgtcaagccagcatcaggagtagagactacagtttcttcatgcctggcccactgccgtggcttcgctgggcctccaggtcaccttgccagggccctccttcttgggagctttcagtgtgagtgcgtgagtgcatggagatttggtttttaatggccataaaatttcagttttgcaaaacgaaaaagttctggagatgggttgcacaatcaatgcaacaatgaggagagggaggacaagaggcagcattgacgttggaactgatggggcacccctgggaacttgctgcttccttacgagtctcttactcccaggttatgaaacggttgacttttaggggatacagtgtggggaagaggcagttaactagcctatcttctggaactgtcttctccacatgctggagttggaaggtgatagcagccagggagctctccaaagcaggagtattagtctttcacactgttgatagagtcatacccgagactgggtaatttacaaagaaaaagaggtttaatggactcacagttccatgtggcggggaagacctcacaagtatggtagaaggtgaaaggcacgtcctacatggccgcaggcaagagataacttcagctggggaactcctctttataaaaccatcagatctcctgggacttattcaccatcataagaacagcaaaagaaagacccacccccgtgattcaattacctcccactaggtccctcccatgacacatgggaattgtgggagtacaattcaagatgagatttgggtggggacacagccaaaccatatgagcaggggttggcgaattatggtcttgggccaaacccagccatccattttgtaaacaacattttatcagagcacagacatgcctattcatttatgcactatctacacattgagttgagtagttaggacagagaccttctactctgcaaaacctgaactatttattatctagccttttacagaaagtttgtcaatccctatgttaaagtgtaaatcagattgtgctaccgtcttgctcaagacccatccagggctccctacgaccctagagtaaaggtcaaatgacttatctggaacaaatcatctagcctcactctgcaggagaattgtcatctgtgaaatgggagaatgaagaagcctacttcaccaatttagagcaagatttaaatgaggcaatgcatgtttcagaagagctatttttaaaaaatggtaaaacacacaacataaaatttaccgtcttaatcattttaagtgcacaatagtgttaagtatattcatattgttgtgcaaccaatctccacaactttttcattttgcagaattgaaattctacggccattaaaaaacaaatccctgtttctctctccctcaagcccctaggtctcaccatcctactcctgtctctaggaatttaattactctagataccttgtgtaagggggaatcacacagtatctgatctatggtgactggcttatttcacttagcgtgaagtcccccaggtgcatccatgttgcagcatgcgatagggtcttctccctttttaaggctggctagtattccactgtatgtgtagaccacattttgtttatcctttcatctgttcatggacacctgtgttgcctccaccttttgactactctgaataatgctcctataaacaaaggtgtacaaatgtctctttaagactctgccttcaattcttctaggtacacacccagaagagctaacttttattgagcactttctagagacagcctctgctttaataattcacacagatcctctcattctatcctcacaacagccctacaaggtgagaactattaagactatcatcattagggtgaccagataacttattatggtcagtttatgaaaagcctgccaatccctttgttaaagtctaaatgagatcacagcactgtcttgctcaaaacccatgcatggctccctaaaggtcaaacgaattatctgaaacaaatcatccagtctcactctataggagaatcctcatcaggttagagtgagactggagaactcttgagaggaaaaaggggctccattactaactataccaggatgacaggcacagatcgggattgtcctgggcaaaccagataccaatcatcatccccattctatagattaaagatcaagcaacagagcagtgaagtcccttgcacaaggtcccgagtgagggaggggcacagctaaaattcaaacccaagccgaccgactcaagctttcactgctaagcacagttctatgtgcttagcacaaggagcggcaacggtcagcaatcaatgtgaggtgtctcattatggactcttcaggctggggagaggggtcttcaggacgcaaagggtcatcaagggctgagaaagtcagaggggtgagggggaggcttttcacacccaggagtgagactgtggatgccaatgtgtccataccaaatgtgaacttgccccatggagagaagcagatgcccaggtctcccaccatgcttggccacggcaccatggacattttggactggaaaatcattgtggggatgtcctgtgcattgcaggatgctgagcagtatccttcgtgtctacgctttagatgccagtagtaccccctttcccagtcgagacaaccaaatgtctctaggcatgtccagacgtcccgaggggctcagtagcattggttgcaaaccactgaatcagggaaagggcagaactagggggaacaggatgttctcccaggtccgggcttctcaaagtgtagttctggagggcagcagcctctggcagaagtgtgatttctcaggttctgtcctcgacctgggtcagaatccctgggggtggggccttggggggtctgttgccaacacaagcccaagtgtggccggcaagcactgtccttgaccacgcaagaaaattgctgggatctcggaggactaggcacgagagatgttactaacgtgaaacctgaagagggatcccaggcagaatgcaggatggaagatgaggatgttttagaggctgtcaaggtcctgttggtgaccaatacaggatatactgttataaccaatacaggcttttcacagggcagtttgatgctgtctatcacaatttaaaatgggcaagctgtttgacctgccaattctattcttcagatgctctgtagcagccagtctcaactcaggatccccaagagaattaagctcgaatgtcctggggcatccgttgtaggtagcaaattagcttttctctgatgtatccagaatggtactagttatgtacatctttgagagatctgagaaaacagtcacttagtatagtaaaaaactggcaacaacctaaatgtccctcaataggggaatgaccaattacactgtggtgtatccatacccagagttatatggtcagctactataaagaaataacttaggtctctagctccaggcaaggaaacagacctcagacctggacatgtgcaacaacaacaaaaaaatcatctaacttgtgaattctttcatcccacagccagatactattaatatattttttacaagtttcagatttatacatcagtttcatatgatttatgaatctcttgtcacaaaaccacactcttttttttgacatgtgttgagtttagatatctaaagaaaaacaaaaatgtacacacaagtgccactgctcagatgggactgacggatcagggtggattttccccttatctgcaatgtttcagtattttaaaataatgagaatgtatacagccttgacttgaggaattagattttaacaagcatcctttctgcattatttgggcaagttcttaaaaatcgtgaggagaattctcctttccctgccttctcaccatcttttcactttggtcgctgcaaatatcaccggggactggctcttggcagcctcccagttcctctgaaaggtttctcactctatccatgccacacttggaggtgagctattaatttgcgctttgtggctcagctcgattctgatttagggcaacataaaccctcctcaaaattgcgaagaataaattagtttactaatttcgccattaagagtttatcaaagcaagcactatttcaatcgtctcttaatcaatcaccattttccgtgtttatctcctgttcaatttttaccagagggttctatacacatcaatttgtctgatgttcttcctacatatgttttaaattactttatcattgtataaatttcacagccattaaaaggctctaacaccagaatgactgacatggtgttaaaaattgaattcaattccacggggtaataaattgtgacctaaatccaatctctcatgggtgactgaaggatacaatgaaaaattattgctttgtcatttttacactaacacaaatataccacagcaactagaaactggcagagaaatgggaggtaaccgcggctggctatttctcaccccaggcaatgaactgacttcaaacacaagtccttagcgtcttggatgggattggcgcccccgcctccaaaagcaggtgaattatctgactgtgtgggtgggtctcattgcaacagacagattgagcacaaggagcaaatgtaagctgcaaagggcttgcttcagcctgaatgcagctgctcctatagacaccaaagtgcagtggttaagccccttgccacgccactggaaccaaagtctctgagctcagagcctggctctgctactggtgaaatgtgtaattctgggtaagttttctgtgtctcaacttctttgaatacaaagttgttatgaggaataaatgagttaatgtggctaaaccttcttaggatagcccttggcatttaacaatccctacgtagaggttaagtgttattatttaagagcagtttcttgtatagagaccttagctccctgttctttctggctgcagagatggagagtaacaagtatcaatagctagagaaaggtgttgattaacatgcagtgcattttcctttatctctggagaagctagatcagtcatttaacacatctggttccacatttactaagggtaccacagagcagacaagttaaggtgtgggttttgaagttaggcagaagtgggtttgagtctaaggtctgtcacttgcaaatgtgaccctgggcaagctacttaacctctctgaggatcagtttcttcgtctgttcaatggaactagagaacatcccttctccagggctgtgcaggagtcgcgatgagatcacacatgcaaagtgctcgcctccacacctggcattcaggaagtgcctaagaaatgtgggttctcgtgtcctagccccgtgcaggcaggggctggagatccagtggtggagactcaggatatgctatagcagccagtctcacctaagggtccccaacagaattaagggtactcagcccttgtggctcagtgtgggctacagagcactccagcaaccacgctatcctgtgacatgtaccccagcagggaacaggcaaggtggtttgggggcacacagcttgagcacctcacacagacttggagaggtgcagtgtggggagacagcatcacagaaggcttccaggaggaagtggcattgatatgaattcctagccctggactgccaagtaatttgagagaggagaaaaggccagctagttttgttgacttatgcagaaaggagagatagctagtcttttcactctagggcttatttcattcattcattcatttattcattcactcattcactcattcattcattcaagggccatgtctgggctccttccttcttgcactaagtctctgtcttggggaccctgggtggcagacacacaatcagttgtgcccaagggagcaagcctctcatggagcaagaattctatgtgctcttcgaatctccattctctgccttgttctggggcagctactgggcaagaactcatggaacgccaagaaaatcatcacaaaccaccctgccatggaagcgagtctcccatgcccacctgcaggcttccagaaccacaagagctgccaatcgagaggtggcctatggctgacttgtaacaggtgcttggtaaatatttgctggctagaccgatggattaatgaaagtacactcaaatacggtattttattcagcaacctgaggaggcaggggaggcccttgtgcaatctgttttataggaaagacgtgaggctcagagaacacaagtgccttgttcaaggctttcgcagccgataaagtggcagaggggccgcaagtcttttgagtttggttcaaaggcttctcctaatccagggtcaggtcaatgatagtgaaacagcccaggacactgagtctatgacattgctggaggcactgaggatttccttccatggcttggatgtcatgagaaacagcactgtaagaggaggaaagacctcccaaagatgtgtaccctaaatccagggctaagaacttgggggcaggggttgctttcctgatccaagatgacctcttgttcagggctcaaaagtggaagaagcatgattctgtagagagaggatgtgagacctgccccccagtcccagcctgccagacccttacctttggggctgatatagtttggctgtgtccccacccaaatcttaaattgtagctcccataattcccatgtgtcatgggaggaacctggtgggaggtaactgaatcatgggggtgagtttttcccttgctgttctcgtgatagtgaataagtctcatgagatcagatggttttataaagaggaatctccctgcacaagctctttctcttgcctgccacactataagatgtcttttgccttccgccatgattttgaggcctcctcggccacatggaactgtgagtccattaaacctatttttctttataaattacccagtctcaagtaagtctttatcagcagcatgagaacagactaatacaggggggcctaccttcccctcaggtctctggcaatttcagttcagtactgagagatgcctctacctccattctccttgctcaaagcaaagacacagatcctctaaacctagcacttttaggaattacaacttggcctacgagcagattaacctttttgcttataggaagagctcccctgttggtcttgtgagtgttttaaactatcaacacctctgcctacccgagggcctttgcacacgatactcccttgacctggaatgtccccctccagcttttcctctagttaactttcaccacccttcatctcttagctcaactataaaacacaactatgcaactccccagaattgctgttgcaattttacatgtgaattttttttttttttttttttgagatggagtctcgctctgtcatccaggctggagtgcaatggtgcaatctcagctcactgcaacctcctcctcccgggctaaagcaattctcatgccttagcctcctgagtagctggcacccaggtaatttttgtatttttaggagagatggggtttcactatgttggctaggctggtatcaaactcctgacctcaagcgatccacctgcctcccaaagtgctgttattacaggcatgagccaccgcacctggcctacgtgcacattttaatgatcgtttacccctgtgtttccctacccaactttaacaggccacaagctccctgaggacggggattctatctgctttcctcccaaatgaatccatccaaactagttcctggcatagacaggggatgctcgatgactaattgttgaatgagggtatattgaagggagctggtgacaaacagtttcaggtcccaggtggtggatgccatgctcagaataccacctccacagagattctagatgcccatttccattgctttgcttggtgcacacaggcctctgtagagaccccagtgtgaagggaggttgagccactgaggctaaaagcaaccacgttatcttctttcccagtgagggcaagactgaggattatgatgtgccaagcacgagatattcaaagatgagtacgatcaggcccctggcaagtctttccccaccatctaaaccaatgtcaggcacaaagcagcctctcaataaatattaaatgaataaaggaattcagcatatccaaagactaggaactgttccatttgcaagcagcttaattcttagcaagttcttccacaatgagaccaaatctatttctgttccttctctaggcacctatgtagtttttttgtttgtttgtttgtttgtttgtttgtttgttttgagataaagtcttgctgtgccacccaggttggagtgcagtggtgtgatctcagctcactgcaaccttgacctcccgggttgaagcaattctcatgcctcagcctcttgagtagccgggattacagacatgtgccaccacacctggctaacttttgttttgttttgttttagtagagatggtgtttctccatggtggccaggctggtctcaaactcctggcatcaagcaatgcacccaccttggcctcccaaagtgctgagatcacaggcgtgagccaccacacacagcctgtaggcacctatctaaatggttccccacctcacctgtcctctcatcctgctcaacgtcttcaaataaatcatagagtcatatccagacattagattgcagatgtggctattcacttgtcacctctggtctctcctattcaggtagaagctccatgagggtacagccatctagacgcccaattgatttccagaaccaatggacatggtactcaagtggcacaaggtgttctctgctcttgttcacagctctaactccaggtcctagaacaaggattggcaaaccacagcctgtaactatctattttggcatggcccttgagctaagaatgggttgacatcttaagtgggtagaaaacaaatcagaagtagaacagcatttcacaacaagtgaaaattatgtgaaactcacatttcggtgaccataaatgacttgaactgaagcatgcccacaatggtcatttgttgatgtgttgtttatggcagctttcacgctacaatggtaaagttgaatagctgagacagagaccatgcattttacaaagtcccaaatatttatgatctggccctttatagaaactgtgtgtgtgaggccctgtcctggagcacagccttgaatgtggtggctgaccaatgaatgggtcttctgatgttctctggatttgccagtctcttgcctttccccagcaagcccaaggaagacctttgggactagttttgtccaactccaatgaactgttactggatacctcttccttcctgggctcctcagaaggagatgccaaagggcccagttggaactgcaagggccgccttgggaaagcccgtcaaccccacccacttagccaagctgttcctggtcaatgtggcttcatcacatcaccctcattagcgtggtaccttttaacttttcacagctattccctcattttctcatcattggtgatacagcaaaggatctgggagaaagtagtatctctggctgacaaatggggaaactgaggtatttacctgggaccacttgtgacatccccagttctattttccctccactgcggctgtcagctacgctttctagaagccggctactcacgctgtgtagttaccccactgcccccagggcaggagggatgtagaagagactgcccttaagcagctggcagtatcatctgccagtctctctctgcagcgagcggccagccttccccccagaatccccatatccaaaaatccattcctgcaaaggctgatgggtaaagacggtttgttgctgccacaaagaacccccttctgttcatcctcacccctaacacctgtgccagcttccccagtcatgcgcaatttcctttgcccatcacccattggagaactgccgacttcactcagatgcccagaccggggttccccactcaagtccaacccacccagctcccagccaatcatcttccctggaacttctcacatttttcatttctaattcttcacctggatgtctagactgcagacccacaggtcacttacagcatctatgtggtggcttaaccagacccagcaaaggggaagaaatgcaggagcaacgcaaggagccagcagggcctttcttgggacattttaactcaagacacagagaggctggtggccgtgagggccactgcacggagggcgcttcctgacatgcaggtgttcaaaatgtaatgaggcagaaaaagctgtgtcacctggcagctggcacagattgcctcctatgggtcgcaggtgaaacagcctttattggaaaagatgctttgacaatgaaaggggcagagatgcacccttcacccaggatccatgtgttccctgcaaccagggcttctggggaagaggtggtcctggaaggcttcccagaggaagcgcattcagggtgggatctccagaggcaagaggtaacagccaaagtggggtgagtgggagttgtggggacagggagggggctggggaggactggaagctactggggctgtgtctgaagagcagacccagcaagacgtggctgcacaatggctgacaccatcaaagaaacccttttcctctcctctcctttcctcttcttgtcgccccttcatttagacaactcctccattgcgacgattaggttggtgcaaaagtaattgcagaaaaaaaaaagtcattgtggtaatactaacaagccaagcacatccacttaacttccccagtgcactcagcattttatatgcattgtctcatttcagccaaccacgctataaagacagaagatgagtttttgtgtccattttactgtgcagactgagtcactgagcggttagggttatgtcatgagtaacggcagagccaggaattaaaccccattgcccaagctgtccttgactttcaatctgacctggttcattgccctgaaacactaggggttccagttgaatgaccagagaccctagggtgtgtggctcaaaacaaatttctcggaggccatcactgggggtgatgcagcagagtcccttccccacacctcactgcatctccctctgcacggttgccagtggacagccagaggaatccctcttcccctcgtgaaaacagctgtcaccgaaaagggatggagctggggcttccttctaaatcccttttctctggaaagtaaaggagaaaagtcccgagagcaaggaatgtctcacagaaagcaaaccatctcctgggcttctggactcgacattttccctgagtggtggtggggtgaggggacagagagcgtgagggacaggaggagtgggggcgctgtaccaaagtcaacatttaaaatctatttctcttcccctgaatttttcagacttgcagccatgaggaattgtttccttaattatattcaacttccagcacactcttggctgaagtttaggtgatgttgcgtaaagcaaaatgagaaacacagggcatccatctgtgtgtatgcttatatgtatatgaatatttactcatatattaaatttccctccacccctgtctccatctcctcatttagcaaagaaataaaaggaccactgggctgaagctcaaatccctcctaagcagagggaaatctgggtgtcatggtttccagaaagggaacacaatccccgtatggggtgtaattacatcttagctttctgcagaagaatagtttatggcttaaatgctattaattgtaagccgttttgttccatgggaagttgttcattgataactacccaattagggttattttgcaattagtctattcacagtaaatttattgcaaatgggggagtctgtggtgtagcaaattaaagcgtcgctgaggctgggtgtgcaatggcttttaaatgccaatcttattaaccagctcacaggtcctgggagggtgcgctatcctggccagtgcactaaaggcctcaggacaaactccggcaaactcacactgcaaagccatccggagataacctcagcatgaccaggagaagtgcaggaacccctggcctaagatgctgaggttctgatttttttgaacaactgtggagcagtcataaagcaaatagggatgcaatgtacattagcactaccaggtacagttcttagctgtgtactaggcccttggaaaccctctaagctaagtgtgatgatgctcatctcccctttacagatggagaaactgaggcacagagaggtcaagcaacttgcccaaagtcctacagcttgtgcacgggacacctgggattcagatccacgtggtctgcctccaccaccccaggctcttaagcactgacagcatcagcacccctggcttcccaataatgccctgccttcttctcccttgcaacttgagagagagagagagagagagagagagagagagagagagcgagcctgcaggtggaagaacacctctggggcttgacaatgtgagataaagtgacccttctgcctccccaagagggacaggcttatggaaagggatacaggctctgtaacatgagttccagtaccagctctgtcatctgctggccatgtgtttctggccaaggactccccttccttgagcctcgatttcctcactgacaaaaagggttcacaatagactcagcctgtagggctggtgtggggacacagtgtgacaaggcagtgttgcacatattagcacaggtgacccttgaacagcacaggtttgaaccacacgggtccatttataaacagattttcttccctcctgccatccctgagacagcagtaataccaacctctcctccttcttctcctccttttcctcaactcaacataaagacaaggatgaaggcctttatgatgatccacttccacttaatgaacagtaaatatactttctcctccttatgattttcttaacttcttttctctagcttacttacatttatttatttatttacaattttttgttgacagagtcccgccctgttgcctaggctggagtgcaatggcacaatctcagctcactgcagcctccacctcccaagcttaagcgattctcctgcctcagcctcccgagtagctgggattacaggcatgcgccaccacacccagctaagttttgtattttcagtagagacagggttttaccatgtggcccaggctggtcttgaactgatgacctcgggtgatccacctgcctcggcctcccaaagtgctgggattacaggcatgagccaccgtgcctggcctagcttactttattataagaatacagtaaataatggaagtaacatataaaatatgtgtttatcaactgtttatgttaccagtaagctttcagtcaacacaggctattatcagttaaggttttcagggagtcaaaagttgtgctctattttttgactgcaaggaggttggcacccctaaccccagaattcttcaagggtcaactatagacagtgatagcattttgcagggttaagaaaactaaaagcccaagggccaaatccggcccatggcctattctttctttttcctttttttctttttcttttttttttttttttttgagatggagtcttgctctgttgcccaggctggagggcagtggcatgatctcagctcactgcaacctctgccccttgggttcaagcaattctcctgcctcagcctctagagtagctgggattacaggtgcacaccaccatgcccagctaatttttttgtatttttagtagagatgaggtttcgccatgttggccaggctggtctcgaactcctgatctcaaatgatctgcctacctcagtctcccaaagtgctgggattacaggcatgaaccaccacacccagccagcctatttttataagttaggtttaatgggaacatagcgcatttgtgtatgtgtggtctctggctgcttctgccctatgacggatggcagacttgaatagctgtgacaaagactggcccccaaatcctcaaatgcctaagatctggcccttcacagaacaaatgtgctgtctctgatatacagaaggagctcaatatttcgttcatggaatggcattcaactcaggcctccaaaacttctccaccaggcacaggttaacaaaagatgctggaaacgttgcactccacttaattattgctacactctgtgtgccaaatctaatcaagaatatagacaggaaccacctcgaccacttagacaagggtgaaacagcaaggcagaaaggaagcttttctttctaaatctttctatttaaaagtatcgtgtaggccaggcactgtggctcatgcctgtaatcccagcactttgggaggccgaggtgtgtggatcatttgaggtcaggagtttgagaccaacggggccaacatggtgaaaccccacctctactaaaaatacaaaaattatccaggagaggtggcaggcacctgtaatctcagctactcgggaggctaaggcaggagaatcacttgaacctaagagttgaaggttgcagtgatctaagatggcaccactgcactccagcctgggcgacagagcgagactgtctcaaaaaaacaaaacaaaacaaaacagatagaaaacaaaagtattgcacagacacatgcttgctactagaaactaaaataatatagatgcacttgttaaagttgtccctgctgccaccctgtccctgcagatgggggggccataaggaaggtttgctgtctatccatccagccctctttctgtgcaatgagtgtaggtggccacctcctatttgatctaaatcctctattctgtgaccagtggtaaacacagaggcacatatttaaaatgaaaaacacctctaattaactgggggacctggcataagtctcctcccctctatgagcctcatgttcttatctgtccagggaatcgaatgaagagttctcaccaggcgcggtggctcacccctgtaatcccagcactttggggggccgaggcgggtggatcactaggtcaggagttcaagaccagcctggccaagatggtgaaaccctgtctctactaaaaatacaaaaattagctgggtgtgatggcgggcgcctgtaatcccagttactcgggaggctgaggcagggaactgcttgaacctgggaggtggaggttgcagtgagccgagatcatgccactgcactccagcatgatgacagagtgagactccgtctcgaaaaaaaaaacaaaaaaaagagtagcgaatgaagagttctcttaagaggtctttttagtctacttttctggggagccattctcttgctgcacttcctttcttcatcaagagagttgggtgaattgaccatttgccttctcaggaggacaccaggcaaagccttgcatggctcccggatgcaccgatgccggtggaacggaaagcccttcctccccaattctgcagctggcttgattctctgactttatgccttgacattgagcagcacctcagtggatcccttccagctgcatctgttgaccctgacacctccccaatctccatctagctcgactctgacatgcccccaaccccatcggagcccccagagctctctgttgcctccttgctggcctccgtgctcatttaagggtcttttcccttcggagataacaaaagcaggggttggtatttggatttagaagcgacaagggggtactgtgaacctttggccactttgtgagggacagctgggctggccttgcagtgtggcccaatgagaaggagggatggccaggagtaaagagtgaagtaggctcccagggaaggtggagcaaaaagacccctagaatgcaagctgctccctggacagataagaaatctaggccctgagagcagaaaggactctccctgttagctggtagctgagcttgaatgaaatccacacccgtttatttcaaatgcattcctctctgtttgttgctagtggcaccaactcttcgtgggaaggtgccttttggatgctatccgccctctccacagagaaaaccactgagcaaacgaattcacaaacattttgagaatatcttctccaaggaaaaaagtaaaatttaagagtgctcccagaggctggattatcgtaagctatggtggcaggggctagcgggagggaagggggcgtgccctaaacaacagtgaccacgagtcaataaacagcgaccacgtggctgggtgatggtacattggggttctctctactctgagtgggtccgaaatttcctgccataacagtaagcttgtaagatcacttaaaggccatgtgaccttgggagagggattttacatctctcatctgaaaaaaattgggctcatgacatcagcatcagcctcagagagtgttggatgtgataaacaaattgactgcacagagcctggtgcggtgtctagcacacagcgaagcctcagcagccccctgtggctgctgtcattccccttccaagggcactagagaaggtgaaaatcactaccaagaaatacacatcaatggcacgattgcacatgcgctagtgaaactggactccccatcttcagatggcccctccactctgcctgtgaatttctggatcagagcttggatccctccgtgtctcagcaagagagctggtttatcatcaggtcatccgcacataaaagagtgccagtgaagggaaagagggaggggaaaagcaaagagcaaggaaaggtggaaagaaggaaggaaggaaggaagtaaagaatgaaggaaggaaaagaagaaaggagggagggaggagagaaaaattaggaaagaagaggacagaaagcaggaaggaatgtagaagggaagaaagaaaataggaagaaaagaggaaaggagagagaaagaaaattaaaataaggaagaaaggaaataggaaagaaggaagggggaagagaggaaaataaggaagggaatgagaagagggaagaaaaggaaagggagaaacaaaccaggaagaaaatgaggaaggaagggaggaaaaagggagaaagaaaataaaggaatgagaaggaaagaaggagggaaacaggaaacatatgaggaagaaagagaagagaagagggaaagaaacttttgatgaaggaaaacggaaagttacagagcctctgaagttaatgcaaccaattagaaacctctcaaatcataatcaattacaataatattcatatcaattctaatcccaatattctactgaaagagaaacgaaaccatatcaatacagctcccttggctcctgccagcatcacatcagctcccgatttcactataatttcatcctttgccataaaggcaatgggttaaagcacctacaaaaggtaatctgattttgcaaaatttttctgatacaagacttcaacactcagggagtactagaacacatcagatctcgtgtgctcatctggggtttggaaaacagggtggcctttctcagaaggtctgagaaggtgagcagaatggggctgggcaggaggaggaagtggccaggagatccctctctgagccagcggggttggaacttaccctcgagggggcagaaccgagtcaccttctcaggcatcagcagccctaacttgtggcggcagtaagtctccccaatctcctggcggcagtgcttggacttagcacgggacagggcagagatggcctccttgcctgagatgtcacacttagggggctggtcatacttggtctcgggggagctgcccccagttttcctggcatgaggcggtctggacacatccttcccgtggctgctgttggctgcggctctgtccccgggaggcagcacctcaccggggcctttcccagggaatgtatgtccttttcctttctcctgctgttccagcttccttttcaaaagctccttctgtctactcggtggcttcttcgccaactcaggctggtgcttctgcttttgagtcctgggtgcgaagttgctgttgtcgacattctcaaagtctttggggacagagttctcgttgttgctgtctgttcgcactttctctttcggccgatgagaaaagtagccatcctggagaagaggggagagaaacagaagagaaacttgactgagagatcatgctaagcagactggcctttgaagagtgagtcatacggacttggaagccggggccatagtttcacatcctacttttgctactggtttaacctctggtaagatggctctctctggacctcagtttccccatctggaaataggagatgttccaaccagaaaccaaggctttttcaagctctaaagtgccatgactacgattctcaatgcttcttattaaccacaccttttcaagtcagtttctttccttgactgtctttgccactgggtaacaaacattttgttccagcgtcccgtttaaattccagctgaaagtgctgtgatggtttacttaagggctggaaatgatataataaagttataaagggaaaaatattggtaggatattacatacattccattgcctttaggacatgctcatatatctatgcccataagagaaatcagactgagccgttgtaaattctgtgggaaagaaaccagccgcaattttttttttttttttttaagaggaatgcagcccttgtagaataaactttacactaagtcctggagcaaagcaaacttgcgacactcttgtgcttgagtttggctcttcatgtgtgtacatggaacagaagtgatgaagtcatttggggtcaagacaaagatcaggagtcattctggagaccacgcatggcatggatgtttccagaagggctggaccccaaactcagctcctccatgggtaaatgggtcctggttactttgatcagtcgaatgatcaaatgcatcattcaaccaatgccccaaattgtttctgcaacatgttgcttctgcttaaagctcattcccaaggccttaatctgaaagcatatccaatgtcctacaacacggcccctgacctctgaagccacagagaagagtaatggctccatatagctgcccttgttgctatggaaacacaggggcaatgggcggcatccctgctagtcctccttttaaggagggctgaaatatgcctcttaccagttcccaaggaaaaaggtgtcggggcctgaacagcggatctgcaggggtacccaagagcagctgaccctcagcaaggctcccaccccagcaggtcagcaaacaactgcctgtgttttttataaataaagttttattgaaacacagccatacctgtccatttgtgtattgtccatggctgctttcctgatacaatagcagagtgaatagttgcaatagaaactttctggtctgaaaagcttaaaatatttctatccagccctttaagaaaatgtatgcagacccctgctctgctggagtgtgagttaaaaggcctcctcctctgggactgggttagttgcttctgtcctcaccatccatatacgacttagtgatggcctggagaagaaggtgcccctaggactgggcgtggtggctcacacctgtaatcccagtactttgggaggccgaggcaggtgaatcacttgaggtgaggagtttgagaccagcctggtcaacatggcaaaaccccatctctaccaataacacacacacacaaaaaatagctaggggtggtggtgcacacctgtagtctcagctaactcagaaatctgaggcaggagaattgcttgaacctgggaggcggaggttgcagtgagctgagattgcaccaatgtattccagcctggggggagagtgaaactggctctcaaaaaaaaaaaaaaaaaaaaaagatgctcctctagcctctgctccattgctcctagcagtaagcacgaatttctcctatttgttggaggctctgacactaagacaccttgtggccattctgtaagctgagtactgctatgactttcattttgcagatgggaaactaagcacccatgaacaagtgacttgcccagggtcacccagctagttggcggtgaagctggaattcaaaccaggcagatcacagaccccacactctgggctaccagggacatgatccacttccaagaaattgtatgatccttattacacccatcacccaaaacccttaagtactgcaagctgacactgaaccacaagatctggcccctcccacccagctaaatgaatctgctagaggtgtgtgacctccaaattgcaatcttcaggctggctagtggcctattgtgttgcaggaagtcatatagagacagtaagcagcagccacgaagcacgtggagtctgaggctgcaggagctgggaggtaacaaggtaggaagaaggaaaaagaaccaagaaaaaaacagctgaccagtccatattgggtcacagggcggctactggttgtacacaggaactgcttttatatcctgacctataaatgagggccttctgcttctggtctttcttattctccacagatacctacaaaaaaaatccccttcagttggtacctagagtacatctttattcttgtaacctaaacaaaacctgctgatgttcctcttttccctttttttctatccagaggcccttgaagagtcccaagcagcctctcaggcgcattttctgagctcttaccatgagccaggcaccacagtaagttattcacaggtattacttatagggtactgacaattggatgtatttatcttgccattttatagaacgaggagccaacgcttgttgtgatacattcttcactatggatcacgtgctaggtgccatgctaagcccttggatgcagtacctcacttaactcctggaaataatttccaacgtaggcactactgttcgcccaccttacagaaaagggtggaaaataaggttggggatgtcgagtaatttgcacaaattcatgttggggaggcagcgaacttgcatctgcctgattctaaaatctgctattgtatcacgcctcttgtgttttgctgagaagtaaatcaagaagcattcagttcccctgcagtggaataatgggtatcaccatctttgctcatattagcgtctgtcgggatggagctgatggggcaggggtggcattcaataaagctatgaaaaatcatttctgttccattccttctagggatgtgttaggattgtatgtccctatcccttgtatattaggcacagacaggaaacatgctatggccaagagcagtgactggaacccataaggtgtcattccctggataccacaatatccagccacactcctgctggtggaggtcatgcatccctgagtgaggcccatgtggagtagagactctaccaaccctcagtgtgcagaaattgacccctgctgctttgagtcactgagatttgggggatctgtgttactgtagcatggtctaactcatcccgattaatccaggagctaacctgatctcctttcttcctttgagctgagtcaggtacaggagccaatttttttctccctccaacagacagaaacatctattgacgactcccatgctccaagaacataaatttaaattctgtccctaagcccattttctagaagtttctagaaatgtctaaagggcagggagtaagccagaagagctactgccctgatggacatcttcgttttctctcttcagacatatcctaagtgtcattctggggcccttctctttccttgttatcagcaagtttccccgccacacaacagaaaacctccacaaacccccatttcaaaagctcctgttctccatcactttctggctgaactttgccaagcaaaaccagacagaaaacactgcgatcatctccctccaccccccacggccaatgaagctaatctgacaatcagagaatggccaattcctctggctaatgtgtaatatcaggaagaggcaccaccattgattctgatgggactcatgattaatacccgctctctactcaagacaggccaccacaatggcgatgattagcttgtggtggccctgtgaacttctgcctggccccagatgctactcagctgccatgggaacccaaaagatttgagtataagagggaaggaaaatattttgtcttctggaacaaaagggctcacagatactagatcgcttccagaaaagtcagagagaggcgcagtcagcgagaattggaggcctgagaatttctgtccctcagagtcactgtcattttctatagtgactgcggcgttctctctggcttccccccttcaattcatttttttcttttcttttcttttttgagatggagtttcactcttgtcacctaggctggagtgcaacggcgccatcttggctcactgtaacctccgcctcccaggttcaagtgattctcctgcctcagcctcctgagtagctgggattacaggtgtgtgctaccacgcccggctaatttttgtatttttagtagagacgggttttcaccatgttggccaggctggtctcgaactcctgacctcaggtgatccacccacatcaacctccaaaagtgctgggactactatgataataacacttaacatgagatctaccctctgaaccaatttttaagtgtgtattattgttgactatgcagctatagtcaacactatagtactatatgcaacatacagcaaattgttgtatattgttgcatgtactactatattgttggctatagtactgcacagcaggtctctatggcttcttcattgtgcatgcatgattgagatgttatgcctgtccatcagcaactccccatgctcctccccaatcccccaactcctggcaactactacttcactctctggttctaggattcggactattttcgatagctgatagaagcagaataaacacgtgtactatctgtccttctgtgactggtttctttcagttagcataatgtcctcagagttcatccatgttgctgtatgttgcaggattttcttctttttgaagctaacatccattgtgtgtatatgccacattttctttatccagccatccaaggatggacatgacatatcacttcatgttccccctaactcttcatctgactgccaaggggcaaacagattttggcttttctgtcctttctgtggagactcaagatccagaaagccaaacccaggatcccttcccttcacaaaaccaatcttgggaggtctccaggcagacccataaaaaataaccatcatatgcccagcacccaagtggcccatgctctgtgtcctttgaatcttcttgaaaactcaccaaaacagacagtattagtactccttaagaggaggaaactaacatagagagaggttaaataacttgaccgaggctacactgctagtaatgaagtgattcaaactctctgtgtctcagtttcctcatttaaaacattgggatgataacaccttggtatccatggggatgataataatatccatctcaggccgggcacagtggctcacacctgtaatcccagcactttgggaggctgaggcggtcggatcatgaagtccggagatcgagaccatcctggctaacactgtgaaaccccgtctctactaaaaatacaaaaaattagctgggcgtggtggcacgcacctgtagtcccagctactcaggaggctgaggcaggagaatcgcttgaacccaggagatggaggttgcagtgagccaagatcgtgccctgcactgcagcctgggtgacagagtgagactctgtctcaaaacaaacaaacaacacctcacctcttgggtaattcagtgaggaagagtgtatgtaaaactactagaatatgcccaccacacaaagctggaagaagaatgagcagtaaaccagactggggaactctaccaattaacactctctctcccctgacagtctctgcctagaggacagatgggttattatttcgcaattgtgatcaactggcatcatcttctctactcttcatcaatccaactctctcaccttgagttatttatgctaatgcaaccctttgacttactttattttaatgtacttattacaatgattgcacattcaaatgtttgtgtgcaagctccaaaactctaattgctctgctgttgccttacctctaagctgctgctagaatccatttttattctggagaaataattaaatgcaataatgtcctccattcccattcaaccttgggcatgtttagagtcaatttcaatcaggtagaaatatgctaaacataatatggctccgagaagcaggttacctgacccacgctgctgctgcaaagacacgtgggtctgtttccatttttcccaggttctcttggttcaggatgaatcaatacttagtctactgaatcctggccccttgctcccatttctgaggggtgggggtgggttgccgtgatttttaaactatccacctttgctcttattgtttatgtaggagaagacctgggtactagtattgcattagctgatgtccaattttcttatctgtaaaatgatgtgtcccgaatgtgtgttactaaccattctgagttagttattaatcaatatattcaatgaacaaaattctgccacttcagctcattaaaacaattcgatggaccttaagagaccaggaactgaggacaaaatggaagcttcaaagcgcatcccgtctgcagccctatccctctattatcgtctatagcagcacactgagattcagaggtctggactcaggaagaagtgagtttgattcctcccttctccatttgctggggttcttcaagctgggacagaacatttcgcctctctttgcctcagtttcctcatccatcccagagagccgaagatggcacctacttcccagggactgaatcgatcaagcatagaagatagtgcctgacacgtccaaagtgcttaagaaacacgtatgtcttaggttccgttccaagcctgttgcatgtactaactcatttaatctccatgatgagctgataaagaagacgctatattttctacccatttttcagattggaacattaaggttcagggaggttaaatgactaagtccacacacctaggaaacagaggagccaggatttgaacccaggctgtctaggtctggaggtcatgcctttcaataccccactgcctctccgcagctattaggaatagggacagggccaaagggaaaccccagccaggtgcactgctcacacatgagggcgcctggcccacccgctcatcgtgatcagtttacggcttccttttgtgccatgtgcacgcacagccggctgggtagttatttggtgttgaactcagtgtccgaggcttcgttccaatcaccaaggctaccaaggccactgggagggacaaacagggagaggcctgcacctgcttccaaaaggacctccgtgccagggtaggcgaacggtggaagcacagtgtgtgtggctgtaccaattagaacatgcaattacccaggctgccaatgcaaatagacctaacagaggcccctcgtccagctcatctgcatgcacaaaaggtggctggccagcacttagaaacccgtggaccacgctggacgcaggcaggccctgctttaacagaaccctaagtaaaaagccctttgcaatgtagcatcatgttaatgggatgcaaaacagcacagggtgaggcaggaaggagtgagactgatagggctgggttggaatccagtctctgctccttaactctgagacggagggcaagaggtttaacctctcagagcctcatttttctcatctacaaaagaagggggtaagaagacctactttgcaaatgtaaggtggggattaactaatatgtcatgcacatataattctatttaacaaaacaacattgggtgagaggcttgatacatgttaagcactcaagtggcagcaggatgatattttaagctagcgccttgtcacttgatgagcaagtctgagtcttttgtttgtttgtttgagacggagtctcgctctgtcgcccaggctggagtgcagtggtgcgatcacgctcatcgcaagctccgcctcccgggttcacgccattctcctgcctcagcctcccgagtagctgggactacaggcgcccgccaccaagcccggctaatattttttgtattttttagtagagacggggtttcaccatgttagccaggatggtctcaatctcctgacctcatgatccgcccgcctcagcctcccaaagtgctgggattacaggcgtgagccaccacgcccggccaagactgagactttttggaaaggcagagtgttgaggcacagtgggttgaaatctggaccctggcctttgctcactgtgtggcccagggcacagtgcctaactttgtctgcctcagtttccttctctgtaaaatggggacaataatgagtacccaatctaatgaggctgttatgagaattaagagtcaatgaatttaaaacacttaatacctagaacttaataaatattaggtataatttattaaaatagaattaatgattgcaatggtgacttaaagtggttcttaaagtgtggtctgggaactgttgggggtccctgaggccttctcaggggatctttaatgacaaactattttcacgataatataaagacattattttcctttctcgcttactctctcatgagtgtacagtggagttttccagaaactccactgcacgtcatactgcatcagaaatcagaagcaaatgtgagaatctagctatcttctattaagccaggtgttacagagatttgcaaaaaatgtaaaacagtgcctcccttcttcctaaatttgttttcgttggggaaaaatatgcatacttttcataaatatattttatatacacaagtaataggttattatgactgtttttaagtgaattaataaacattttaagaatgccttagtttaaatattactatataggaagtaattgatagcacctacctaagccaaagctctttggtgttcctcaataatgtttgagactatacagcaatcctgagaccaagtttgagaactactgacataatacataagtacaatcagaaatatttactgattattaaaattaaaagtttaggattcttttatgtaggctgttttgctacatgccaagccttttgatttgtattttacttccatacacaatacacacacacagaacagatagaaatcgaagttgagtgataaatactttttttttttttttttttctgagacggagtttcgctctttgttgcccaggctggagtacagtggtgcaatctcggctcaccgcaacctccgcttcccgggttcaagcgattctcttgtctcagcttcccaagtagcacggattacaggtgcccgccaccatgcccgactaatttttgtatttttagtatagacagggtttcaccatgttggccaggctggtctcaaactcctgacttcaggtgatctgcctgccttggcctcccaaagtgctggaattacaggcgtgagccactgcgcccagccgataaatactttcctatagagagaggaacccaggcccctcaagtcctgaatcatcctcagggaggaagaatgacctgctgtcaagagttagtccttgatcaaactctagtcagcctcctctgccccctttttctactgggcctctcagctttacctataaagacttgaatgaaatgctaacgttgtttttctttttctttctttctttcttttttatttatttattttttgagacagggtctcattttgttccccaggctggagtacagtggtatgatcacgactcactgcagcctcaacctcctgacctcaagcgatcctcctgcctcagcctcctgagtagctgggactacacaggctttcaccactatacccagctttttaaattttttgtagagacaggaccttgctatgttgcctaggctggtctcaaactcctaggctcaggcaatccttggcttcctaaagtgctgagattacaagcgtgagctaccacgcctggcctgaaacactaacatagtttctcacagctcaaggcaacatccctgggatgaccccagctcctgcttaaagtgactgctttagaaaactcaaggctgccaaaataatttactgtttgttccagctaacacctctagacagggcatcatctcccagcctctgtaagagagcaggagccacacttcataaacagcagttagcaaacccatttgagtcacacatagaccaaccctcccttcctgcttttggtaattcttcacttccctgagtccactgagctcatctcccttccctccctcccacctctctccttctccctttattattattattattattattattatcattattttgagatggagtctccctctgttgcctaggctggagtgcaatggcatgatctctgctcagtgcaacctccgcctcccgggttcaagcaattctcctgcctcagcctcctgagtagctggaattacaggcgtgtgccacaatgcccagctaattttttttgtatttttagtagagatgggatttcaccatgttggtcaggctggtctcgaactcctgacctcgtgatccacctgccttggcctcccaaagtgctgggattacaggcgtgggccaccgcactctgcttccttctctctttaaaacacccagtcacctctgaacaaatccaagttgagttcagttccatgctggatgcttttcctattgcaacaggcattactgattaaatgtgcccttacccctttcatagggtctggctttgtttatgtttgacgcagcccaaggccacctagcctggacctcaagcctacaaggctaagtccttggggtaaaaaccaaagagcccagcaaagcgtgctcagagcccagcccctgacttaacccactcccctcttcccaaccccaccagggggacatgacagtgacagtcacagcgctcagagcacccaagggactgcaggcaggtggcagggaaagatctgaactggcatctcctggctctttccctatcagcataagagacagctgtgtggtacagagatacacagcagagggcgaaataatggcagaggagaaaaagacgaaaaggaaggaaatgcaagagaaaatggaacgagaagaagaaacaaacatcagctattgtttactatgtgctgattacctaccaggcacggagctaagcccgtggcttggcatcgctattcattcctcaaaattatctcaaaaagtaggtcaggggtcagcaaaacaccctaccacctgcttttgtcaataaagttcttccaggacacagccatgcccattcgtgcacacactgaaggtggtgcttttgtgctaggacggcagagttgtgtagctatgacagagactacatgcccagaaaagccaacatctggctctccgcagaaaaaatgaatgccccttcaaatggggccagtgaggctgagccaggcttgcccaaggtcactcggtgggtaagaggcagggtcagaagtgacgcacaggagtcagactccagagacaacatgaggttgcaaagtcagacccaaggacagagggagagagagcagagccttccagaaatgacaacaaccatgtctgttttggaacaaaatgcctcacacacagaagagcttttctatggagagaggcctcctaactgttttttgtttgtttgtttgtttgtttgtttttaagtgtcccgaaggctggcctcttcttcgttactatttgaacacagtttgcctctaattaattgcagcattccattgcgttattccacagttatggccacaatacccaaagatccagagagaaagggggtgtggtagagacacagagagagagacacacagagaaagacacagagagagagagacacagagagacaaagagagagacacagagagaaagatacagagagaaagatacagagagagacacagagcaagagacacagagagagagacagagagggagacacacacacagataggcacagagagaatgtgaacaacccagtcttgctttaataataaagccttctgcgtacctctcaggcagggtttctcaaggacagcgctgttgacatttggggctggataactctttgttttaggggctatcttgtacattgcagggtatctagcagcatctgtgagctttacccactagaccccagtcatgtgcccttgttacaaccaaaaatgtctccagaccattgtcaaatgtctcctggagtaggagtggggcaaaatcaccttcccacccccgacccctgctgggaaccagggctcaagggcccatactggccgatctcagctgctcaaatcctgttcccattcagaaacagcctttctttccctcattttccaacagaaacagaccctggcatccagccagagcagtcagaataggagagaggctggtatgaagagagctggctggagaaagggccagagttaaccaaggaagggtattccagaggggacagagggaggaggctggctggggtgaccagggagaaatggcagctgcatgaggaaagcgggagaagttagggttcccgctagggaaggatgacacagaagaggagggacacattcatttgggcagtggatagtctttgagttgatggcatgtcttttaatttattttttgttgttggttttttttttttttttttttttttttgagacagagtctcgctttgtcacccaggctggagtgcagtggcacgatcttggctcactgcaacctcggcctccaaggttcaacaaaatcctcccacctcagcctcccaagtagctgggattacagatgcgcatcaccatgcccggctaattttttgtacttttagtagagacgcggtttcaccatgttggccaggctggtctcgaactcctgacctcaagtgatctgcctcccttggcctcccaaagtgctaagattacaggctttgagccactgcgcccggccatgtctcttaatttaagccagaagccacaaccgggaccaatggctccttcaggcacacaggtgtctggttcactctgtagactgttttcatttgtttaacttaatctcggcccacatttcaaaatctagagatttcatctaaaactttggatttctgccccttctggaaacatcagggacctgacaacactgagcttagatttctacgcatgacagttgtcttgaggctaagtagcggtcccatggtctccagaaggggcatctgctctgtccggcccggccagtgtccccttagccctctggcatgtctgcacgcggtgacactgcttcccaccaatgacacaggctcttccgggaggccttctacctcctgagctttgcctcggagatctcagaaccccaaaagatccttgtattccagagtgtttgatggaggtggcattgtccctaatgaggtgttctggaagcgtgtggtggcatttccagttatcacaatgattgggggatgctgttggcaatgagtgggtgggagaacatcagaaacccagcaggacaggggaacactcgtggctggacaatgaagagctgtcctgcatcctgcacatcttctgaacgtccccagatgtcctgtgcgtaaacaactcatttataattatccaggccaggagcctaacttagatttacatatgatacaacattattatgaatggttttaacatagctgaattttctaggaaagtaactactgtttcactcaagaagagattttatatcacttagtttgaccacagtttcagaaaattacatcatcaaaggccacacaagctgtggctgtgagtcaccaacacacacatccattccccgcctgcatttgtaactactgaattctcactgactcaatacgcagtagctgacctcttcatgtatcctccagccccttgcaaccaagtgtggaccactggccagcaacatctgcatcacctgggaacgtgttagatgtgcagaatctcaggccccagcctggaccacaggaatcagggtctgcacattaacagcatccccaagcaattcgtctgcacatcaaaaattgagaagtacgccaggcatggtggctcatgcctgtaatcccagcactttggaagtccgaggtgggcagatcactggagttcaggagttcgaggccagcctggctaacatgatgaaaccctgtctctactgaaaatatcaaaattagccagttgtagtggtgggtgcctgtaatcccacctactcgggaggctgaggcagaaggatcgcttgaacccgggaggcagaggttgcagtgagccaagatcatgccactgcactccagcctaggcgtcacagtgagaatctgtctcaaaaaaaaaaaaaaaaaattgagaagtgctaatgttgttgcacccatcattcattcggtcagtcagtcagtcattcgtttattttggagacagggtctcgatctgtcgtccaggctggagcgcagtagcatgatctcggctcactgcaacctctgcctcccgggttcaagtgattctcctgcctcagcctcccaagtagctggaattacaggtgcacgtcaccatgcctggctaatttttgtatttttagtagagacagcgtttcaccatgttggccaggctggtctggaactcctgacctcaagtgatccacctgcctcagcctcccaaagtgctgggattacaggcatcatcatttaaataataaaacatattatctgtttataaattgctgtcatatatttcttcttcatactattttagcagtctattgatcttttttagagttgtgggtgtttaagtaggatagaataaggctggatttcatttctggttgggtgaaaggaatgttttaaaagatttgtgacattgagcagggctgggtctgctggggttaaaatcacaggtttattcattccacatatgttatttgggtgtccactccctgacagatggggcaggggaaaaggatataggaaggggaactaaagtatgcttcctgctgttggtggaattctgagaaaagagaggaaagtaagtatgaatataagttattttaatataggaccaaaagggagtgtagggatgggtgtgctcaggatttgaatttcatcaagggtgtggagcctcacatggtctggggtccaaggagaatggaggagacttcacagagaaagcagttttccagcctcatcttgagaagaaaggagcaagacagacaaaggaaaaaagggctttccaggcaagggcaaagcatgtgcaaaggtgtggtgagaggaccagcccaactccttttataataacaacgatcccagctaacacttagtgaacatttactctaatgactgagctacacactttatatagattatctttaaaactctcagagcagggccgggcacggtggctcacatctgaaatcccagcactttgggaggctgaggcgtgggaattacttaagcccaagagttcaagagtagcctggccaacatggtgaaaccctgtctctactgaaaatacaaaaattagctgggcgtggtggtgtgcgcctgtaataccagctactcgggaggctgagggaggaaaaacgcttggacctgggaggtgggggttgtagtgagccaatattgcgccactgcactccagcctgagcaacagagggagactccatctcaaaaataaacaaacacatcaacaaacaaaaaaccccagaacaactctattgggtaggtgcaattagtatccacatttcacaggtgaaagtatggaggcatagagaggttaagtaacttgcctcaaatcacacagcatggttataaacttacattgttactcctgtgggctgttaacaactacgcttggctcagtgccccacaggtttctaaagtcccccccaggaggaaacaccacttccaccaaaggccctggaagaaagcaatcactaagtgagctgatctttggcctggggtggggaagggaggagtccagaagtaagagagttatctgaaaagcctgggttcctggtgtaaagtcctcttgcctggctgcctgtgattcattctctacctctgttatttgagattcatttctaggttggtgccacgcccctgactcctgaaagccacaaaccacaatattctatttgtcccctggttttatttccctatacaccttctctgtctctcttgattcaactcccaggaagccctcttgtcctaaccatcatccttcctccccaacattctccgatccaggtcctctgggacggggcacttaaggagacaaatgggtctcctgctgttgaaaaacacccagttttcaaactcatcctttgcctgtgtgggccctatcccccacacacaccctgccacagtgggtaatgaatggttcacttgtaagctcattaccgcagggcctctaaagaaatggaaatgctcacggagccagagacataaataaggagaggcgcctgtaaataaataaatatagatgcacatacacacacacaaacccagttaatttctatcatctgaaagccggaaccatttggggtggggagagagagaaagaaataggctcctaatattgccatccatgtgatttcagaactgagcttccccagaagctgctaataaattatttttactatgcagaggtacaaatgaatatgctgctgtcaccccctaaatctcctttatgagcatgtgtttgccttggcccaacctactggggacaggggcttccgagcaagttttcattggccaagttcctgaaggaggctgccatcttgaaggtctgctctctgtaagctgcgggtgccccactggcacttcctgtttatgcctgaggttggcatggcctgcaggacatccaatgtcgattggaaggccacaggaatcaaagtgacagcagtgcctacactcaagcttttggaaaatgatttctgcagcctggactgagagctgctgttcacaagatggaatgtacccctcttggccatatacttcaataggccctgacattttctaccaagtttcagggtggatatgcaaaaacctcatcactaccaactttcgcgtgcactgtcatcatccagaaggaaactctggtcactccctttggaggcagtgtatccaatgtccagttctccaactgttcagagcaagaagtaggccatggaaatcatggtgatcatgatatgctaccaggacacgatgggcaccgtccgatgaagttgttataaatgtatgccctggagtcactcttgaggatctgaaatccagctctaccacttcccagctgtgtgacctagggaaagtcgtttaccctctctgagccttgctttcctcctacgtaaactatctataatatcaaaacctcgcagggctaaaaagatacgctgacttaaccagtgcaaagacacagttcagaatagttagcagttaataaaaggtagcggttacccacatcatttcatgcgaactcctacaacgacttttcatacattcattcacagatatttactgagtgccaagtacatcttaggtgctggggacatgtctgtgaataagacagacagatgcctgctcctatcgagcttatattttaatagcatgagacagacaaccatcctaccaacaactcaataaacagattctatcacaatgttgggcatctgttatctatttttatctattttatttttataatttcaacttttattttagattctggggatccctgtgcaggttagttgcatgtgtgtattgtgtgatgctgaagtatggagtatgattgaccacttcacccaggtagtgagcgtagtacccaatggttagttttctaacccttgtccccctctagaagttctcggtgtctactgtcaccacctttttgctttttgtttttccagacaaagtctctgtcatccaggctggagtgcagtggcgcgatctccaatcactgcaacctctgcctccggggttcaagagattctcctgcctcagcctcctgagtaggtgggattacagggatgcaccaccacacccagctaatttttgtatatttagtagagacggggtttcaccatgtaggccaggctgttctcgaactcctgacctcctgtgatccacctgcctcggcctcccaaagtgctgggattacaggggtgagcccccgggttcaacctactgttttcatctttatgttcacgtgtactcaatgtttagatcctaattccaagtgagaacatgtggtatgtagtcttctgttcctgcgtcattaatttgcttaggataatggcctccagctgcatccatgttgctgcaaaggacctgattttgttcttttgtattacccactgttcccagatgtgggaactgaggctcacagcggttatctcagcaggtttatgagccagagttgtcccacccaggagagttttggaagtgagaggagcaaccagcaagagaggccggctgcctggctgacaggtaaaagctttgtttcctcctcctcctgcccctcctgccatgattgacagagtgagacgcctccctgcgaacatgaggcatctagttcgggtagacagtttgctactggagaagttccttattcaaggggctgagcagtagtggcaccttttcgtgtatgaccagccagccgtgcccagacttctgaagtctggctggattcagacaccgaactccctttagtcctcaaaggacccatgaaacacccaacacaaggtggttccaagagacccggtggaccgcagttgttcaggccactagatggctctttctgtgaaatttgcagagagcaagccggcagctgcaccttgatactgaagccgggctgcttccctttggacagtcaggacgcatctccgagaagttcttcttcattgccgcaggtgggtgggtcactacctcttcctttaaggggtattcccattaaggcttttcacttcagaggagtttgacaaggcgagactgggatttccacactgtctactaaatcaaagtcattgccatcatgcaactttctgctaactttcccagcttcaagggaaaagtggagcttcatggagctccacttcatcatctgttggcttcacatcatcccatcagagacaagctccatataacagcatctactgtttacccaagattttgcacgattctcttgtttcatcctcccatttatctttggtggagatattatccgatgagatagaaaagtaaactgtggcacagaaagggggttacatgactcaggcaaagtcgcccaggaagcaaggggcaaggctgggatccatcctaggtctgattctgaagcttgtactcttcactttacagcctcatctatgcacagggaagatcctcctgagctctgcaagtgtccaaacttagaatgggcaaccaaggctgactgtgaacatttccttcctggttgggctttaggaagagaagcgaaatttgcctattacctctacacacctcctgagaccaggagaatcctgggtgacaccaggcattcaaggatttcatgatacagtctctccctccctaatgcacctttcagcgttgctactgggacagcatttcctgtgcctttttaaatttaatcctcttcacagccctctcaagaggcagcgcggctctgtgatcaggagcatgaatgctaaagccagactacctgggttctcaacttagccgtgccgttttgaagctgtgtgaccttgggcaggtttcccagctgtagccagctcatggagttgaaatgagaattaagtcaatgttgggaaaacacttaggacaaggcctggaacacaaattgtagctgttactagtatgatcattaatagtagtatgtcctttttcaacatttgagtaaacagaggctcagagaggtgaagacacttccttaaggccacacagatcagggatttaagccatagcaccagacctgggagccaagctaatattccctctccaacacagccccttcaagtcccaggctggaagtgagctgcccttcttagcagtgaaacacctagaaaattggctgacaatttatcgagggcgtcttcaacaagtgtgtcattttggatacactgtgggctaactattggtgcagagagtgggctgaggggtcagcttcttcagcatctggcttcatccatctctgggtcattgatggcttctgtcaagatggccaaagaagaccacgagagtcaggctaggcctcctcctctgcatattaattacagccaaggcaaaatgtggccacagcagcagttaggggacaacaggaccctgcaagtcctcaagcagtcaggcagaggacaccttgggcaccccgccctctgcccagcacaatcttccgtggcactgccgaggacctcagcaagatgcagacctccagggatgtcagcctgtctcctcctctaggtctgtcctctttctgtccctctgtttgtccctctcccctctctcaaccacctctccatcattctgcaatcaacatcctgcccatggtcagggatatctaaaaagctatccaggctgggcgtggtggctcatgcctataatcccagcattttgggaggccaaggcaggcagatgacttgaggtcaggagtttgagaccagcctggacaacatggcgaaacctcgtctctaataaagctacaaaaattatccaggcatggcggcagcacctgtaatcccagatactcgggaggctgaggtgggtgaatcgcttgaacccaggaggaagaggttgcagtgagccaagatcgtgccactgcactccagcctgggtgacagagcaacactctgtgtcaaaataaataaataaataaaaagctattcatcttctgaagaatggaggtggtcagattttgtcttattttctgaaacatacttcaatattttcctaatacaaatatgtgtcagatataaaaaattccaatacaatctagatttatgaaataattcaaaatgtattaaaatgtacagaaaaataatacagtgcccttccatgtaccaattttgttatgttttattcaattatttaaagaaattagactttgcagagacaactgggaagttcctcccagctttcaaccaccatctcccaacccagaggacacttctatccttcacattcatgtatttatatttttagttaatacgtatgtgttcacatacaatgtatagtgttattttgtgtatctgtaagtttgacaaaagggcaccgtgctgtaaatatctcctttgcgtttgcttgtgtcattcaatattagcatttctacccccatctcctctctccttttattttctctcttctcaattcttcttccctcaggtaacatgatgcagaaggaatgacagcatttagttcaccaattctcagccttgccttcccattggactaatctgggagccttcacaaaatgcagatgcccaggtgcccacacgggagatactggtttagtgggttggggctgggcctgggaatcacgatttctaaaagcccccagacagcgaggggtaagcaactggatttggcccctctttcagctttgggtacctgctgtgaatcaaggtcactcctgctcagaggccaggtgaaggaagcatctgataggctggcctgcagcatccaggggagcggctgaaggacaggtactagagctggaggcaggcatcagagccccagtgcccggtcacgcccggggttgtgactctgcttggctccatgcagcatccaggggagtggtggaaggacaggtaccagagctggaggcaggcatcagagctccgttgcctggccacacccggggttgtgacactgcttggctccatggtactctgtggaccctgctcccaccatctgtaaactgagtgtgctgggtgagggcagtacttcctaacacttcctcccttcactggataattttacttggctcacatttaaacataaacatttatgttgttaaaaaaaatgatggtcatgattcctaaaattcaaacaaaaggaaaaaggaacaatgctatggaaccctggctagaccaagttgcctggctaaggctctgaacccagagagtcctttgtctgttgcacagggaaatgtgtaagtgttggcaaggtgttaaggacatcagcaccgtgctgagactttctcattggtttaatccaagagattgcaggagcactggaaaggcaatcatttcctccctggatgattcaaagttatttaatatccacagaatccccgcaaatcatcttgggtgccaccgtgggccacaaacacttcttggaaacacatggacctgggtcagtccctctggtcccttatcacatggatgctgtagggttctatggttctatgggccatacctgagattccattacaggggaatgtcactcccctcccttctctctcagtctcccagaatggggatggatgaagagatccagggtgagctataattcccctcacccagccttaatctggctgtcttcccggccagagctctccaggcaactccactttctacctccaaataatgatggtagtactaagtgcagcactgactgtatgctaggaactgttctaagcaccctgcatggtctagtccttttaaacttcatggcagccctagggggcaaacacagtcagcactcctatttctaaaatggagaaactgaggcacagggaataaaataccttactgaagaccctcaccccagcccccgacttccctaccccctggccagtaagtagccacgaacaactgtactacaatgcccttttgaatggcgggggtgctgacagctgtctatttgctctaaagatgtggctgcttcagggagcaagtgagcagggggagaaagaggaaaagcatttttagaaattatttccgacaggtgaccacatactaaaataacaacatttggtttgccttgctagctggaggcaaaaatcggctcaggtgggagggtgaggctgcaggctaaatgcagacaaggctggcttgccctgagttggcccagttctaggaagggcaccggcatttctgccattaattgatgcactgggaacccccagcttggttttctttaaggagagaaggagctgggtctttcatggtgtaactgtgaaaatgagaacctcccaggggctgcaagacctggttgtatatggagtccagtgagctattttagggacgaagtgtaaaattgtggaaaacagttgtaacacaggatggggtgtgtgtatgaatatttttattgaaagcaagaatatttactgcatacttactatatgccactgttgtaagggattaacctgcattacactatttcatccttgcaaggatccttagatatagctactattgctaaccccatttcacagacaatgaaactgacacacagcaataagtcaccccccccaagtcacacagctagtaagcagctcgttcagagcataaaatccagggctcatcacctccaaacttcacatattgcatgcatagacccacatttccagaacgcctaagaaattcccagtcatccagcacgagtggatggaaatgaaggggcacatcccgtcctcgcttggaaggaagaaggagctagccctggaaaactgacagactggcacgtctggaggcaaagccaagccaacgggagcagatggagcccaggcagcagatgttaatacagtttgctttttccatatgctcttctgtttagctgtaataagtgaattgttctttaatatctgtcaggagctcaaactctgaaggccgggggcagtcacagtcactcaaaaagacacaaagggaagctggccagccgtctcttcacatcccagaggaagggtgcagaatgtgaagaaagatgccaaacacagcaaagtccaggtctttgtgtacacacacacgcatgtgcacacataggcacacacgcacacactcctcgcctgccatgacagtgagattctcacttgacattctagagtctttgaaatcctgcctcagcgtccttcccactcagtaataacaactaagtagaattttcagattttgcctttgaaatgacaacaatgaaagacccaatttgaaatgtataaagggctccaacggctttgctccttgggacttccaacgcaaccacaactcatttccttaatcaagggcagcagggccactgcagaaccctgtcttctgtcttaggatacttcacgtgtcttgggacatccagccccatcactattatcacataggggcggggtgtgatggtgacgtctgtgaacagtatttcttcaacgatatttccatttgacaaccatgaattaggactctcatatagtctcaccaacttcatcttctttctaagtatccagctgtgatactgttatccgcactaccactatacacccgcccagtcagagaataaacacagagggaaggtcccctggtcctcacagttccagctcaacatagagcagaggttgagttctgagctaaacctcagcattatcccttaaaatccacgtgaccttgggcaagttacttctgacatttctaagcctcagtttcttcatctattaaatggaaagaaatagcaccttcctccctcaacagtcctgttgcgaagatcaaatgttaagaaatgcaggttaagtgttcagcacagcaaccggtacttagcaaacacttactgaggagcagctactatttttttattattacttctatttctcattcattcattcatcccactaacactggagcaccttctaggcaacatacattgtgctaggtgctcagtagtgaacaaaacagattcagctcctgccctaatggaacttacattctacagggggagagataatagagaaataatagttgtccaatatgatatgacctggggatgagtactttaaagaaagataagacaggagagaggcagcggatggcatttcagatggggtcaggtaggaactctctgaggaggtagcatttgggtggcccaatggtaagatggagcttctccaaacacataccgggcaaaaggtaccaggcagcaggaatggtaaaagcaaaactctcacagctggggatggtgctgtgcacctgtagtcccagctacttgagaggctgaggcagggggatcacttgagcccaggagttcgaggctgcagtgagctacgactacaccactacactacagcctgagtgacggagtgagactctgtctctaaaaattaaaaatttaaaaagcaaagctctcaaggcagaaatggtctaggaccagtctagcagcaggaagaggaagatggggctgtgatatggagaatagactcatacagcacaggaaagcaagatggggctgaacctgggtacacagagaggagagaagtccgtatctcattctaagtgcactggggagccactgggggcttaagcaggagagcatgccagatctgactgatggatcctggaagagcccactcacccactgctcacagatgcagagagaggaagcaggggcagaaacaaaggtggatgcagccctggccaagtccagactgagatcagaatgcattgcctgggtgctgctccagcctcttctctccggggtgttgctggggagggatgagggaaaatgcacaagtgatgggaatttacttagaagtttctggctgcaagcttgggtgactagaatcacccaggaccccatggtagtgatgatctcacaccagcaaatggctttaaatcagaattcaaatgagtctggtaaaccaggataaagtgtgtaatttaaagcatcccggaagccctgggaacttgcgctagatgcttctcgatctgctctcaggggatctccagcattattctggagagatctggtagcagaattaatgactctggcatttcccacctgatctagggctttgatccttcctgccccatgactgtctcagaaccaaaggttgtgggacaatgggcactgtgcatgtgcccagaccaagaatcagcatttaggcctggctgcaaatttcaccatcatgcccgggggccctgctttctgctgatgtttcagccaggaatgccaggcccttcacccctcaccctggcttgcattcaaatgacccctgcctctgtctccttcaccagactttctcctcctcctctatgcctacagaacacttttaccaactccactacagaactttccacctgaattgcttgttaacatggtatagccccctaaaaatgtgtccttctgaggagcagaacttattcaagtttataacccccaagggtctagccccaaacctggtgtatctctgtgtgtgtgtgtgtgtgtgtgtgtgtgtgtgtgtgtgtgtgtgtccatgtgtgtgtgagtgagtgagagagagagagaaagagagagagacagagagacagagagagactgtgttatgccaatatcaacataaacagcagctaacacaatgggggtctgggcccacgtgcctctctgctaatcactaactttcatgatcttctctgaccctcacaataaacctgtcatagaggatctattattactccaaacatacttagactcaaaaaggctaggacatttgctcaaggtcccggcactagtaattggtaggactggaatttgaaccaggctcatgtaagctcataaatcaagacccttctccaccacacttacttgaaggggtaaacagagactgagcaatatgtgggaggagtgggtgggaggctggggagggaggtatggaataaataatcatggaaggggatggcagatggaaattagagaaattaatacatccaagaatgttctcagggttttggtcaaaccatggactgactcaccaatataaagaccactctccttgtcatcccaaaccattcaccttcaagtatccacggatctgcactgtcactttcttagcccaggtcaacctgtcacccatgtggatccttgatcaacacagcactaaaattgtatgtaaaactggcttagctaatactcattagctagccacacttaggcacattacgtatattagcttcttgaatcctcacaacaatccccatggataggtatcatcatcatcctcatcatcatcatcctcatcatcatccccatccttgttgtaaggttttccagcaagcaatggaagacggggacttgaacccaggtaatctgccaccttcaccacaaagtatagccatcgttgattgtgtccttacactgctctaagcatctccccatgtcttctgctttaagcaaacttatgagatggggagtgttttcattccaattttacagatgaggaaacttacgttcagagttcaaaccctgaattctgttcaggtgtttggggaggtcaaacccaccaaacaccacccagccaaggccacgatcattcactgatcctgcagctttatgagaataataaaaaagattccccttactctgggcaattgcagccctgagtctacagtatgccttgatgaccagagtgtaggtgaattttggctcctacttaactccctcctgtagttatatcctgaacaagcatacgcagaaacactgcagccagctaaaaataggcagaactgagattcaaacccaggcctggcgtggatctagtttttcatcatgtagatgctccatcacccactcagacaccactccccctctttttttttaatccagttcaagaatcaacccaatccaaggctgctcaattaacgctcagtgcagtatcctcaagcaggcaaacgctcagaacgtagacggatccctctagatcatactcctcccacctcctggggctgtggccacttcatcacagtctcagaaaaaactctgggctcacagaaggtaactctgcaccatgagacaatttgtcgaatccttgcagccggtaccgcatgtggccaaatctccccaccccaatcaggcagccacttcacacagtgacctttcctgatctgcactgtcaggctgcaatttagccattctgaggactctgttggaggctgcttcagccaaaagcttgcctctggggagccctcccagggccctggactccgttcagatgtcactttgcattaagggcccactgtgtggggctcctggagaggaagaaagcaaatctctgctgaatgtccctaagacagaagtcaagtgaggagcaggggaggcaaaagaaagacagacagacagacgctgggcatctaaagaaggggtggaggactggtagttccaactggcagcagaaataataataccaggagcttaacatttaccaatcacttaggaaaaaagattaatactaagtgagagtttaagatgtgccaggaactctattaggcataatttttctttttttttttttgagacagggtctggctctgttggccagctggagtgcagcagcataatcgtagctcactgccacctcaagtgaggctcaagtgatctcccacctcagcctcccgagtaaatgagactacaggcatacaccaccagctaatttatttatttatttgtagtagaagatgaggtcctactatgttgcccaggctggtctcaaactcctgagctcaagccatcctcccgcttcggcctcctaaactgctgggattacaggtgtgagccactgggccccacctagacataattcttcaggtgggggccggtaacagttactcctcccttctccaatataaaaatagtgcagtgtccaagcagagaggctacaagataaatcaattgccagcaaaacccttggtgtataacttagctatacagtttcactcatggcaagagtaacggcagctgggatttcttacttacctcctacctgtcagggattgtgtgtgattcttttgttcttcttggggcttgtcttattatgcttattgtagaccgactgtactgatggtcccaagcaatggcctgctgtatgcttgcccttggcaatgtgccctgctgcttctcccaagaggttgagatgacttgtccataccttgaatatgggcaggtcatgcgacctgctttggccaaaagaaggtagcagaggtgaccctaagtttggcttctctgtcttggaaccctgtcactgccatttgctctctactggaggatgagagaccacgtggaggcgagtccaaatgactttcctctcagttgagataatcctagaccagcttagaggcagccaatctccagacatgacagcccaactgagatcaggagaaccaccactgagaccagaagaaccatctagctcacccaaagactcttgaacagtaacaaataaaaatttcttaccgttttaccccactgagtgttgaggtgatttgttaaaacatcccaagaatacaataaatagatttttttaaaaaacctgagcctcagagacataaagtcacttgtctaaggcaacccagctgataagagatggagctgggattctacaccattgtaagttttcatccacgatgatctatacctagggtcaagaaatcattttctgtaaaggactggctaataaatattttaggccttgtaagccatacagtctctgcctcaacctctcaaccctgccattgtagagtgaaaccagtcatagggcgtatgtaaatgaatggtgtgctgtgttccaataaaactttatttctaaaaacaggtggagggccagatttggcctgtgaatggcagtttgctacctcctgctctaggttgcttctctgtatcatcaccatttgtgccagcttttttcccctttctctgtctgtcgcctccctctttccctcctctagaatttccacataaaatcccgcaattgtcttctgccatgtttatgttctaccctgagacatgtgacaagtacctctcaactcaaggggctttgtttccccagcgtaagtgtgtctcaactccctgatttcataaatctatgtcatttccagaaatcagtttgactgatgtgttttcccaatgttaggatgatatctttctggattccctaggtatgggaatttaaaaagttctgattgcattccaaatccaagacccaacatcatcagggtgacagttgagaatgcaaatgactcctattcagaatattaaaaacaaaagcttcagttctgtacctaggaaaatttgactggctccaaaaaaaagtttgcaaaaaaccaaaatgaaaacaaaacaaacgcaaacatgcaaacaaaacaaaaccccaaacccagagtgatgcagaggaaagtctaagagctgtttcatgatcccacacaccccgtctctggggcaacctctctgtaagaagcaagaaaggaagatgacgatgactttctgcagagaacaaaaatttggcttgaagcaaatgaaatcccagtgattttccattttaaggatatctatctcatccaaaaaataaaatgttataatagatttcattttttccatctctttcttgttctttttgcctcttagctgtcctacttagaatatcgaaccgtgttggcaatcaaagtagactctgaacttggctactttctcctcagttaaaagaaaaagaaaaagaggtagacttgagtgtttagcaaagcagctcatccagtttagaggctgaaagccacatcttcaaaatttcaaccaaggaaagttagggttagtgtcaaactttccataatttttaacaactttctaagtaaaactagagatgtctatctggactgactttaattttaaaagtctaaagcaccaaaggcagcggaaggtccatctcatgtttcattacggttaaattctatttccaagaaccaccaacctcagtcccgggacctggcatggatgaagctatttctggaggctgccatgactcttggagccaagaacaaagtggaaggagacgccttacaggcaggggccttcaaccgcatggaagtaccagcagatcctgtgttcagaatcccctactgtactcttagctccccaaactgttgaatcgacccaaggaggtgtcaaagcctaccatggagcatgcacttgtaaatgtctgcaaatgacatgggctttctctgtgttagatgtggaataatcactactaacataattatctccattataaagatgaagagactgaggccaaagtccaaggcccacagctagtgaagggcagagctgagattcacagccagctcatctgacttcagggcctatctgaaacatgacaaaataactgacttggtaaatgatcctattaatttgggtgatcagatagaggtggttacaatgtcctggggtggatcaacaccctggctctgccaccaaatcctgatcctcctcaggccacctgacaattgtcttattttattcatttatttatttttgagacacggtctctgtcacccaggctggagtgcaatggcgcaatcatatctcactgcatcctcagcctcccaggctcaagggatcctcccacttcagccttctgagtagcaaggactgcaggtgcacaccaccacacctggttaacttttttttggcagcgactgggttaatatatgatttagtgggcaccaccacacccagctaactggctatttatgacttttttgtagagaagaggttttgccatgttgccacagggctggtcttgaactcctggacccaagcgatcttcctgctttggcctctcaaactgctgggtgtgggtgtgagccattgtgcctggcctaattgtctcattttaaaagaactttcattcaatgagcagcatatgtaagatgtgggacctgtgaggttggcaggctgaggttatttcccattacacagatgtcgaaactgaggcccaggggtcctgcccactgttacccacctggtagtggcacagtcaagtatgaacaacagatcctgtgtgtccagcccagaaccaatagaggggtttggatttgggtggggtggaacacacccacctcaattttcccagcctctgtctgttctaaggccagaaatcctctgaggcccctgagctgtgttttcctaaagctctgaaggtcaaatacggtgctgaggacctcacacttagaatgtgctgagaaggggtacaggaatgaaagctgctggcttaagtgaaagacatatacaaaaagacctggaaattgtattttatcgcaatagctatttattcctgctgttcggtgttacaaaaatgccatgttccaaaaaggcttaaacaaaagacactgttccactgaccaaaaattaaacagataaaacacagtgtggggacgaggtgtggtaaggaaaggaatgaagagaaaagaatatgataggatggccaggcacggtagctgacacctgtaatcctagcacttagggaggccgagacctgtggatctcttgaccccaggagttcaagaccagcctgggcaacatggcaaaacatcgtctctacaaaaaaacccataaataattagccagctagccgggcatggtggtgcccactaaaccatacacacacacacacacacacacacatatacacatatatatctgtgtgtgtctatatatatgttttttgaaaggttctaaatattatatatattatatatacatgatgggaaattcaatttgccaccagaagcatttaaaataataccataggttttatgagagatatgacctctgtctctgagcttatgagacatgtgagagatatgaattgtctttgagcttcctagcaggcaatgcaaagagggaaacacaattagttatttgaatctgtgtcacagacgagattcctcacttcacaaaaaaaactctcccatctctatttttttcgtgttattatctcttgattgtgttctgtttctcacatatcagttccatctctgtatttgctgagctgatctgtgtatccaaaatgacctgctgtgcagggctcttcacaatagcccctgaaattcagagaggctggctgatgtggatccctgtacagctctggtatagtcaagtgtttatttactgagcgtcacctgaacagactggcgatgaaggagaagtttaaaaccactttggtaggagacgatgccaccagaatagcaatgggaaatgaagcagagaaatccctggcattaaagttgaagtgaatgagaaaagcacatttgtgttgacatcatccctgttggcccacacatggtctttcagaaacactttcctgcacaaagtggggcacatgggaatacagaggccacttcctcacatctctccacactttgcccagtcccacggtcagggatgagacgttcatccacttcatctcagccctgagcactaagggggccacagtgggcagggtcactgtgtgggagcctcaggaaccaggactctggcacatgctgggcagctccatgcaatggaattgtaagctgagttgggctccctgcaggcatgggagcatttcagagccaaaattcccacctgcagctacaagcaaagagagtggaggtcctactttagctaacccgtaaagcgggcacttccaagaagacttttactggaactctgtgctagaagattgggaagttgattctctgtcggctacccccactgctgcctaggggtcctggaaggttgggaggggaggagaggtgactgcaggacagggtatcatggcatccccgagtttacctccaccaaacacacccaaaacctctgtttaacacccaacaactagtatttaattttcattccgctgacctgggagcatctctctaatggaacttccacttagcatagccactgaagttccccagggacagtggtaccaattaaataacgtgacactttggaggtgtaaagctatgtatttactcccaaaccagaggcttgggtagtttttaacataaagattttctccctccttttttttttttttttttttttttttgagactgagtctccttctgtagtgcagcggcacaatcctggctcactgtaacctctgcctcttggcttcaagtgattctcctgtctcagcctcctgagtagctgggattataggcacccatcaccacacccagctaattgtttgtaattttggtagcgacaaggtcttaccacgttgcccaagctggtcttgaactcctgagctcaagtgatcctccctcctcggatgcccaaagtgctggggttacaggcgtgagccaccacgcccggccagaatctctctcttaagagtcaccactagtgcccaatgtttactgttcagaaaggtcattgcccagcagttgcaggcaagaaaccctggacgcatcttggggaaatgcatctaaacaatgcagagcagaagacaggaggggttcatgctctgagtacaggctctggggtcagagaagaatgggtccagatcccagctccatggctgtgcaatcttgaacaagttgcttaaccactctgggcctcactgtcctcacctgtaaaataaggtgttcctgaggcattaggaatgccctgggcgactgtgctgagaatgcaggagcagttacaaggctaagcaactgttcctctgaaggggtcccctgctcagcagagcctcaaaatttggtcctgtctctgcttagggctttctgacaaagcagagtggggaagggaaagggaggtttctggaaaagccagtggccaacttctgggtaccgcggacaggtggcaacacctgtccaaggaccaggcatctctcaggctgtttctaggctgctccacatgagggagaaatgatgggctttgctggccagcccaacaccgtcagagggcatgttactgctcgaaagtacaaaataagcagagtgcgcataactaaacactatttttatcgtctttccgccactctcatgccacaagcaagagctgctgtgtaagggagggtggcagggagatgtttattcagagcatggggtggcctgaataccaatggggccagttgagaggctgtgttgtaagggcttttaggggacagcacccaggagaatcgcagccaccctcaaggctgacctaggagacaaaattgccttcctccccaaactcagccctgcaccctgctgccctgggtgaggaccttatctttcccccacctaggaatctgcaagggtatctttcccttagcatcaggaacaaaacttaccctccagctctgggcaagaaggatctgaaaatgacagttctagggtcgtttggggcaggtacaagcacccttattcctggtgtccagacagtgcatggtgtaggtatacagcaggtactagatgacaattccataaaagaagtaacatccaagggcttgggaggcatctacgaagaatggcaacaaaacccttgccttcacagaactttattctagcacagggacacagaaagatgacagatataacaaatagtgcacagaatagggtagaagagagaagtcagtggttaggatgatgcaatgggtgcatttcttaataaggtggtcaaggcaggctttagactgaaaaggtgaggtataagcaaagactcccagtgggtaagtgagcatgctgcttggctaactgggaaaaagcatttcggggacagggaaactgctgtgcaaaggccctgaggtgacagcaagcctcacgttgctggtggagaccagcaaagaagccagggtggaggaagtaaaagatgaaaaacagaagcttaggtcaggaagaaatgggggatagatcaataaagcattatagagccaggtttttgttttgttttgttttgttttgttttgttttgtttttggagacagattcttgccctgtcacacaggctggagtgcagtggtacgatctcggctcactgcaacctccatctcccaggttcaagcaattctcccacctcagcttccagagtagccgggattacaggtgtgtgctgccatgcccagacaatttttgtatttttagtagagatggggtttcaccaggttggccgggctggtctcgaactcctgacctcaggtgatctgaccactttgacctcccaaagtcctgggattataggcgtgagccaccacacccgacccaagagctatagttcttaactgggtcaacttgacccacaggggacatcttgccatgtctggagacatttttgttgtcacacttggggaaggggaatgctaccagcaactagtgggtagagtccagagatgctgcttaatatcctgtaatgcacaggacgaccctccacaactaagaatgatctggccccacatgtcaacaagttcaaatctagaccactgtaaggcctctggcttttgctctgaatgagctgggattatttggtgaatgaatgaaccccctctgtgcttgcactgatgataacacagactgtaaatctggaggtgtttcatcttcctccaaaccatttctcgcattcatagagtaaggaagaaagaaaagacaccttttttttttttttctccctgcgccaaaagcacacagtggaactcctggttttgaaatgtcctattttatgtgggacctaaaaggatgccaactgtcttctggcctagtgacaacaaaagtgacttcttggaaagctgcggtaacatggaggtggctagggagcagtccaagggaacaaaacaaaacaaaacaaaacaaacctaaaccaaaccatgtttagcaaggcctggggggtgttggggtaccacaggaggcaggctcagcgcgtttatccccatgtaaagattgcagagatggggctggggcttcgcgggtgatttttttagtgctttcacctctaatctccaaatcctagccctgctccttccagaaacctacagccttgcctaaattttgtgtgggtgattaaagcagaggacccgattccctgttcctgcctctctgtttgtgaataatcaaaggctaatcagccaaggccccaggggacaggaaattagacgtgcaagataccagagaggctctgagaataaaactgcgaggtgaatctgacatcaatgccagcaggggtgtctgggctctgatgggcaggagcgcagagcccggggccaactggggacaaatccgatttctccagggctcagctgacctctggcttacaccaaagacagagaaggacaggctgcaagaatctggcttttctccatcagctcagggatcagtcaaatcaaagcattaagaatccagggtgaactctgatattagcgagggcaaaggggatgttctccagactgacacaaaccaccggggttcaaatccccgctcctccacttcctggctgtgttacagtctaaggtctttgagtctcaatttccttatctgtaaaatggaatcaaatacaaataatcaggaatgactttccgagtttcttttggtagaagagtggaaatgaatggagaggaggaagcagaagtactatttagtgactcttgtgagctagacattgtgctcaatgctttagatttatgtttatcgaattctcctaacaactcaatgcagtattggatattccattttcatatgaaaatgctgaggtctcaaaggataaagcacttgcttgagtcagggaaatgaatcccctttccatctgcctccaaatccatgttttattagtaacaccacccaacacagagcactttgaacttctcatgtgtactgccatgctgggtccttataatatatatcagcacgggtgcagtggctcacgcctataatcccagcactccaggaagccaaggcaggaggatcacttgaggccaggagttcgagaacagcctgggcaacaaagtgagacccgcccccaccgacggtgtctctaggaaaagtaaaaaacttagctgggtatcatggagaacgcctgtaatcccagcactctaggaagccaaggcaagatcacttgaggccagcggttcaagaccagcctggagaacaagtgaggaccccatctctaaagaaaatgaaaaaaaaaaaaaaacttagcttggtatgggggcccatgcctatagtcctcactactcaggaggctgaggtgggaggatcacttgagcctaggaggtcgaggctgcagtgagccatgatcatgccactgtgctccaacctaggccacagagtgagaccttgtctctataaaacaaaacaaaaggccgggcgcggtggctcacgcctgtaatcccaccactttgggaggtcgaggcgggcagatcatgaggtcaggagatcgagaccatcctggctaacacggtgaaaccccgcctctactaaaaatacaaaacattagccgggcgtggtggtgtgtgcctgtagtcccagctactcgggaggctgaggcaggagaatggcgtgaacccgggaggtggagcttgcagtgagccgagatcgcgccactgcactccagcctgggcgacgagcgagactccgtctcaaaaaaaaaaaaaaaattattcctgccgagggagccagtgttaagagctatcacggctccattctacagatgaggaaactggagcacatcctgtaaggtctcacttgccaaaatttttgtctccaagagaaaaccagaccctcccttacaaaacaagtcaaaatgagtgtaaaatcggttccgtcaggtgacagccatgaggagacggatggtgtcacatctagtgggggcgagggaatgggctggaggtatagtgtgtccagttgcaggaccaaaaaaccttggcccataactaacgttccctgcacagccaccccatgccacacgcagagcccaggagatctcatctcatcttcacagcacgcctggtggcgagtgccctcactgttcccattttacagatgaggaagatgaggctcaaggagctgacgtcatttataccacactgctattgagtggaggactgcagagttgaaccgggttgcttagcacctttcctgctgctctgaggtcccttaaagtctctgtgaagcgtaaggatgggaggtgggagtcctgaaaaactggtctacctgctgctgtgcgagattgagttgggacagtcagctctcccctctctggcctcagtcttcacccggcagggaaggggctccactgaaggtccttcagctctgacctcctgtgctgctcttcatagaccgtcagctgctgcttcctaatgcaaatgctgtcacttgcctcagggcctttgcacttgctgttctccaggccaggaaaaatatccgtctggatatcctcatggttcactcctcaagcaacttgtcagaggacacgccctatgagagccaccaccccctgccccataggcattccccattcctctaattatgttgctcctcaggccacgtatcactctctgggctattaaagattataattataatctacaatgtctattattaatatgtataatatatatttgcttattgtctgaatatattctatttatatataatattatgtatttgcctattgtctaaatcttccaactagaacgcaagctacttttttatgtcccttcagtatgcacaaaccctggcacatgacaggcattgggtaaatatttgtggaatgaatgcctggatgcattaaatccatttctgggcacctactgcacttaaggcagacgggaaatgcacgtggttaacccaccaccaccagagcatccagctccatgcctttatcaacctggccaccatgtttcatcagcaaatgtgaattgggggaaataacagaatgaagagggggtggcagtaagccccagcaggcttcaggaccagataaaggaggccaaaagattccatttgcacaaaataccatgcagccctctccatcccgttaacccgctcttcctcaaggaacttccagaacaaactattgccaaacaccattgagtttaattactcagatgatattaatagtgcagccagctttaattacagacgacgctgctgcacaggggctaaagacaccctctgaattgctagcgtcccttccacctcgcttctctagctgaggtcgccatatgtgggagttgatttagccttgactctgccatagagacttaccagcaagctttaggagaagagaggctttttgtcccctgcagaattgaatgggggccactcatgctagatttccctaactgccagaacatagctcttatataatgaaggcccaggaaggtctgcagaatgagactggttcgagttcttagagaaaagtttcagaaagacgagggacacaggaaggattctgcttttcccccatcctggtggacatgaaggacccaggataagctatgatgctgctttattaacgaccctttttcaaagcactgaccccggcagcaggaatggaatctggccgcctaggctttctgttaatgagatgagaactgaagttcaaaaataaactgtgggaagcctggtagggaaataccagatgacaagaggataatctggtgaccaaaggcataaaaggtggcgggggtggggagcccacagctaaatcaataaccaggtcgggaggaatttgggggtcaaaagagtggcttagctgttaagaacatggtgaaaactgaccttggatggctccgtaagaatcttagctttgtggagatatttttgtgcctctgacaaaatgctatcttttaagaagtgtgcacagacttcatttctaggcatgtaaccttcacatttaacttgcatttaagcaaaatgatatgcgtgtagggaggattgctatggcgagtttttaattgccaaagactagaaaccacttcagcctcagcagttgtggtatggttaaataaaccatgctatgtgaatgcaaatgcaaaataatgcagctatttctttctttcattctttcttttttttttttttttttttttgagatggagtcttgttctgttacccagtctggagtgcagcggcacgatctcggctcactgaaactgctgcctcctgggttcaagtgattctcctgccttagcctcccgagtggctggggttacaggcacctgccaccatacctggctaattttcatgtttttagtagtgacggggtttcatcaccaccttggccacgctggtctggaactcctgggctcagatgactgcccaccttagcctcccaaagtgctggagttacagatgtgaaccaccgcgcccagcctaatgcagctattaaaaagaatgggggccatgatatatatactgaaccagaacaatcgatgagctagataggtaagcgacaaaagcaagacacaaaataacacgtacagtttgctgctataagttagactgtgctttaagcaccgtctagagcaatccataagacaattcagatcctttctcattagctgtgcaactctgggtatgttactttacctctctgggcctccgttcctttctctctcaactagagctttaataggagttagtttgtatatctaaagcacatattctcaatagggatgactgtcacccccaccaagcaagcaaaatttgggggagtatatgtgtgtgagaaaaaaaaaatcttaggctgggcacagtggctcatacttataatcccagcacttcgggaggctgaggcgggtggattagttgaggttgggagtttgagaccagcctggccaacatggtgaaactctgtctctactacaaatataaaattagccaggcatggtggcgggcgcctataatcccagctactcaggaagctgaggcacgaaaatcccttgaactcaggaggcagtggttgcactgagccaagattgcaccactgtactccagcctgggcaacacaacacaactctgtctcaaaataataataatagtcttagatattgcaatggtcagccgtcccccaaagctcaaccctatctgataaaatcttttcccacagtatttaatttctctcacaagggagaatttatattaaattaaatttttcttcttgggagggtgataatgaaagaaagtaatgcttgagtaatactgagctaaagtactcagaacagcgtgaagcagatggggtgacatttaccttgcaatgtcgctgccaagtttaaatacaataatagatgcaaaggccacagtgcgaaggcgtttcatcagactccaccgcaacaacaggtggcgaatgctaatatcaactctcacttcttagatgaagactcggaggtttacaaaagtggaaagactaggccagaggtcagcatctgagctggaattttcacctggtctctctctcagactaagagcttcctctttatgctccagtggtgcttggagaccacatggtctgtttgttctggtagcttccctaaaatacatgtcagggctcggcacagtggctcatgcctgtaatctcagcactttgggaggccaaggtgggcggatcatttgaggtcagaagttcaagaccaatctggccaacatggtgaaaccccatctctactaaaaatgcaaaaattagccaggcgtggtggcatacaccctagctactcaggaggctaagatgggagaattgcttgaacccaccaggtggatgttgcagtgagccaagattgtgccactgcactccagcctgggtgacagagcaagactcgatctcaaaatactactactactactactactaataataataataataaaaaaatacatgtcgaggtcaacccaggcccaggtaccaggatgtgtccttactctgctgagtatcagcataagatgtcgagtctagaccaggggacaccgtcgtagcagacagccatgaatacctcatcctgtctgctgttagcaagctgcaaagcctgctggtccttcctcttcctcctcttgtgaggccctctggagaaatttccatctgaactgagcactgagaacagatccacctgccatgagcaatggcctgtgtcaattatttggatacagggcagtggaagggacagatttgttttccttgatggcagccagaaagctctttgtcaaatctccagttccccaccatggtgtaggtgttaatacctattccagctccaaggtatgatggtcctatggttgtgtttcctttctttgtctcagttttaatttttgcagtcttattttgtttagtacacccatgcagactgccataaacccttcctgaaagagggatgggtgtaaagagatgaatcaacaaaccacagaacttcaaaaggttccagaaaaaagccaccactggcacaataacgggttactcaatcccccaaggcttttgaggaagactagggaaggaaggggttgaccttgggtctagaatgggtgagggggagagaaaagagaaagcgagagagagctagcaagtgagcacacatgtgaccgtgagcttaatgcaaggggataagctggggtagggttggcagtatgggtagggaaggggagtacatgggaaaggaaaggggaggactggagcttcagtcgtgatggatcttgaaagacagaccactcactgattccttggtttactcattcattcattcaagaactaccatgtgcaaagaattgggctccctgcatgagatacaatgatgtaaaaaataatgacgtggttcctgccctcatggaaatcatatttagttcaggggttggcaaactacagctttaagaccaaatctggcctgcaatcctcttttgcgaaccaaagttttattggtacacaaccactcccgttcatttgcatattatctacagctactgtacagccacgctggcagaactgcttagcggtgacagagcccatgtggccagcaaaggctcagatatttactaatctatctggtcctctacagacagtttgcacacttctgctttagctgctattactgttgctgttgcatattatttgtgagcatataaaaatgtttccaataaacaaagagacatgttgatgcccccgtgagtccccagttttctctgccataaaactggcataagagggccattgtgagggttctaggaaaagctctaagaaataagcccagaacacagacacctacaatccttttacattttcattactaatgatattacaatggctgggagtaagaggaggaatcatttcacgccacatgtctgtctttaaaacacattcagccttttcactctgattctagaaacaggtatgattagttgatcaatgggacctcaatctagacaatccaggcatttgaccacattctcctgatttttcagatgaagattttttttcccatcattttgacatttctggaactgaggcttatcttataaacactgtgtacatatgatttattaatttgtatttgttaagagcaaatgatgtggcagacacacaagatacaggaacaaaatacatatgtgagcaatgcatgtgtgtatatacatgtgcgtgtgtgtgtgtgtgtgtacaggtgcatgcagatatatatgatagttcataagacatcaatttatgctaacgttggaaggtaagaaggcataatttatgcttatgttggaaggtaagaaggcagtaacaccttaaagtctgtcagttggtaataaccatcgtggtgaagggaaaaaaaagtagatcagaggaacagaggagagcagcagtttgcaattttcagagcaatggctgggatagcattcctcccaaaatgacctttgatcaaagaccagaggcaggtgaggagcagatgtgctggaattctggcttcaggcacaggtaagggcaggtgcaaagatgactatctctgtcagtgtgtctttttttccccctccttcctccccaaagctgttgccaacacaatactgtcctccagtcacagaaatgctgtatgtggatggtataagcatgctgcgaaaaaatgctgcagggatttggaccatttggaccgcgcaggggagggtgttaaagtgattgtaacatgttttatttcagctagttcttcaagctcagctcctttgaaatagctgacatgttttcttggccctcaacctgctgtaagcctacgtccaaaagcgtcatatgtcaacaacctggtaaatccacagttaagattttttttttcccacaaaaagtcatgggaaccaaacaggctctgaccaaagttgctggaccagttaaaccactaccagttacttctttgcccacggtgagtaaggctgcttgggaaggtaacctattttctctgaatactctcaaagcattcaagataaatatatctattcatttgtatatcccccaacttggcacagatgaggccttgggtttggatagtaaaatttaacactaccctatgacatttcaatgctaagtttcttggcaaactcaccaagattgcagctgtaggcccagaaagaaagggtgacagcttccagatggcacaggaatgatctggaagtccttgcatgtttatagcaccactcagtgccgcagggtgcccactgtgggccgggggtcatgtttaatttcactaactcctgatgatgagcctgcatcatctccctattgtacaaaggaggcgacagaggttcagcaaagtgctgactgcaaagccatcccagttccccaaatcaggatgcccccttgtcttgaccacccaggacaggatgggagtcattctccaacttagattccagttcatgtgtccaatgtgagcctaagactacagtaactaatctcactactttccctatctagtttccaaaacaaaatgtcctctggataagagcgaacagcagaatggagtttgtgtgtatgtgtgtgcagctttagttttcttaatatttacatataatacagaataccttcttcttcttcttttttttttttttttgagatggagtctcactctgtcacccaggctggagtgcagtggtgcgatctcggctcactgaaacctccgcctcctgggttcaagcgattcttctgcctcagcctcccgagtagctaggattacaggcatgcaccaccacgcccagctaacttttgtatttttagtagagacagggtttcaccatgttggccagggtggtctcgatctcctgacctcatgatccctccaccaccgcctcccaaagtgctgggattatagacgtgaataccttctttcttaacagcattaaacagacgaagtattgctcgactaagcatttgtaactataaggacccggcaaaccccagactctgacttccggagaactttatttccacatgaaaagagcccacacatgttagaaacagtcagtcctgtgttcagattccccttcccctgacaccgccgtggtggggagtccctgtgggggcagtcacttctttcttctaacctgagtctgactcatcctctcactcctctggctaaggacaggaagggacagtaccctctgagaacctgctgagaactgctgtgatgtcccttccctgacccaaacagaaggaggtacccctgaaaaggagacaggattaaaaagccaacccagagagcctctgggtgccaaaggactgccgaagctctttaccctccctctgtatgtggaaatttcagggtaacttaccaagtgctttcttctcttaggagccacagtctgtgtgtactcagattgggagaatgcaaatataagcggttgggagagggaaaaagaacaagagaataggagcgagaacattgggagagagagaacaagagacagataataaatgagaggagaaaaattcgagctacacaccattttcaccctatatactgactttgaagccttaaggtcagccaggcacagtggctcacgcctgtaatcccagcgctctgggaggccgaggcaggcggcgcgcatgtgtatactccaagctactctggaggctgaggcaggagaatggcttgaacccaggaggcaggggctgcagtgagctgagatcacaccactgcactccagcctgggtgacagagtgagactgtcacaaaagatatatatatatatatatattccctctaagtctaagtaagatacaattcctctatacgtgtgtgtttcactttatgcagcagacagacttccaaaaaactggatatgaataaatttcttaaaatctttttatatacatgaaaagtcacaactttaaggtaccccattcatgaggacatgaatcctttggtaagattaaacatccaaattcctagaaatatatccccttgggaattttgagtttcctagtcttgaatgtccttacattcatgaagtcaaaagggtattagaggcatctcttccagccccttcactatgcagaggaagaatctgaggcccagagaggcagggtgacttgcccaaggtcacacagctagagtgagtcagagctgaagcctgaacttgggagtgtagtctctgtagaggtgcacgtactggcggttactcacttgtgctacctgaaataaatggacctgagaatctggtagttatatgagcctgcagttttgtggggtttttgttgttgttgttgttgttgttgagacggagtctcactctactgcccaggctagagtgcaatgacattatctcaggtcactgtaacctccgcctcccgggttcaagcaattctcctgcctcagcctcctgagtagctgggattataggtgtagaccaccacgcccagtaatttttacattttagtagagatgaggtttcaccatgctggtcaggctggtctcgaactcctgacctcgtgatcggcccgcttcggcctcccaaaatgttgggattataggcatgagccaccatgcctggccgagtctgcagttttaatgccttattttctggaagtcaaaactgtattactgaggtgtttctctttttcattacaggagtcatctctattttatttatattttgcagtgaaatgatttaaatcaaatgtgcttgggtgcagaggaaatctgatctgaaagagagtttttatggcagagagagagccagcagatacttatttcctgccttgaagaggccagtaacatcctggtacaaggggattcatcaatacatctttcataagagggcttctctgcacagtgagctggaaaatctttccaatgactctggcccatttgtaactttgcccctgaataaaagaagggattgatcggggcttggaatgcttccatacccagggccttcctgcaccccaggaggcagagtctataaatggaattcaactgggcaattgctcatggagagaaaacccagcaggggtaagcacagcctctaaggagagggcagtgaagggttaaaggtgcaccaccttcctctgctggggtctgcagagggactgatgcctggaagtctctaaaataaagagtctcaaaaatagtcagagagacttgctattgggtattctatggactgcagatccattccccactctccatgatctgcagtgtatgctggtggtgggatataccctcagtgtgtccatcagtcagtcagttggcatttctcaagatctacaatgaaccaaagcagagtgagagagcttgaaggcttcgtaacatggcaaaggggcacggagaattgaaaagtatgtccagttcctgtagacacatcccacaaccccaacctcccaagatggtgccagtaagctttctgttgggtgagagaccaggagacctgagctccaccctggaccctgccacttaagttagcagctcttagggaactgatttctccctttgggcctcaaaagcatgtccaagttgactaagcctgctttaaaagttacttggagaagtgctgagatgattaaataaggacagagtccaacaccaggcacaggacaggccctgaatgaagagattacttcccttctccttagaacctttcctctcctcacccagctccctgtaaggtgaagatacagctctatctacaaagaacggtcacttctctcttcctttctctagggtggtttgggttcaaagacggaaactgtatttgcacccttgcaagctggttcggtccacacttgctttcctacccaaagaccaccacaatccctagcttctttagaacttccttggcatgtgaacttgaacaataccctactcttctccaagacccagtttcagggtaaatgggattagaaaacctaatttagtcagagttgctatgaagattagaaatcaataggtttcccagtacctgacacatggtagatgcccaataaatgaaatttattattttctgcaaggaaaataacatctatctcctctaattgtcatgaggattagaagtaaaatacaaagagcatttagcgcagtgtctggcgcaaaatagcggatactgtatacatcttggttgatggagacaaaagatcaaaagaggaacgtaaacgtgagcaaaagcaaaaaataaaaataaaaaaaaaaggttcaaggaaaaacaaacgtctagcccagagcctagcaatcagagagagctagaaagatatgcgcctaatgcaaagtaggagaggtggaaaggcggctcagagacacgcaagggtctacaacacagtttctcaaccttgacactgctgacattttgggctggatcattccgtcttgggtgagtgctgtcctatgcagtgtaggatgttgagcagcatccttggctctacccactagatgccagtagcatccgtcccccgtagttgtaacaactaaaaaaatgtctctggacattgccaaatgtcccttggggaggcctaattacccccagttgagagttgctagtctaaaatagtgtctgacacaccgtgggtcctcactcagcaaatacttgttgaaagaaggcagggatggaggggagagggatcaacgctgaccaccccatacctgggtagggcaagccctctggcttgcctgggctgcttcagccataatgaacgggtgggagggaggctcttcatggacatgcatcagcttggtttctctgaaacaggagggtgttcctagagtgtactgtctgtgctgtgccttgttaagaggggaaattttccaagaacctatttttccagcgctgcagatttcacgtggatatggccttaaacatccacaaccctgaacctgcatctcattcctctgccttcaaagggattctttggaagcacttcttgtcccaaatggtttaatgcctttattttgcgaatgagccattgcagtcaagaagattaacagggttaagatgtgtgcttgtggttctgggcttagtggtggaaaaatcatgcttcttgcttgtgaacttaaccttttggtggatggtgagaaaggctatgtggggagtgaaataaaatgcataggtcacgggggtaggggccccaggggccaggggtggcagggaagagatgccgtgtgtgctcaaaggcagctcaatttggaggctgggagtgggaacacatcatccctgtaaagatgggatcagattgaaacttctgggacctgatttcaggaatgagctgcaacaaaatgcccgcacacttcttgaacaccttccttttcctccccagctaaaatcctttcctgattcctcagtctcccttgggttcattcacttccctccagccctacttttcccctcttgcttctgggcagtatctttagccattaccaggttttcactcacaccaggacctttgcacatgccacttcctcttgctaaattaatcttcattccatttacacttcttcctttcagcttaaatgtcacttccccggggaaaggctcctgttccctttgggtcaagactcacagtcatacagtctccgtacactgggaatttaatcccatttcacttatcacagtcccactcagtgactggcatctgtccccaccagatagtgatgtggcctgagagcaggaattgcatcttctgctcaataatgtgccctcctcctactcagggtcagtaaacatctgtggaataagtaagtgcataaatggggaaaaggcaggcccggcgcagtggctcatgcctgtaatctcagcactttgggaggccagggcaggtggatcatgaggtcatgagttcaagaccagcctggctaacatggcgaaaccccatctctactaaaaatacaaaaattagccaggcgtggtggcacacacctgaaatcctagctactagggaggctgaggcaggagaatcacttgaacctaggaggcagaggttgcagtgagccgagatcgtgccactgcactctagcctggatgacagagcaagactccatctcaaaaataataataataaaggagagaaggaagagagagctttgttccgagtgtagacaaagagggtttctttcaggggtcatgtcccacagctccattcccagacaccattagaataaaacacagcatggtgtcagagcacggagaaaaaggtgaacttccttctgcctcctttccagctcacacgcatcttgtttccagccccaaacttgatgaagatggggctcccttccttgccttcagcccaggataatcacctgctgcaaatttacccggtgtttaaattgtaacagcaagtcaccaagctcttattgtcacagtagcagaaggggttacatcagagtagaagatgtggaccttggcctcaaggagcccagcagtatcagcactcaggagctggttagaaatgcagactcccaggccccacctcagatgggctgaattagaacctgcatcttaactaggtcctctggttcatgtgagcagcctcgtgggctgctcatgggcttcagtagcctgctcatcagaatcatctggaagatttgttaaactacagattgctagagccctgccttcacccccagtatgtgattccaagagtctgggggtggcaggtgaaggtgcgtttctttccatttcccatgtgatgcagctgctgttggttcaggaccacgcttcgagaacagctgccctactgctcagacccaggcacacagcttagtttccagccagatccatgggactgtgggtgaattccttccttcttcaacaacgttgatgctgatttcatgctgtttgtgcaacttaggcagtaaaaagtttcctttcccccttgtgtgtattagtctgttttcacactgctgataaaggcatgcccgagactgggtaatttattaagaaaaataagtttaatgaactcacagttccaagtggctggggaggccgcacaatcatggtggaaggcaaaaggcacgtcttacatggcagcaggcaaaaggaaaatgagagccaagcaaaaggggtttccccttataaaaccatcagatctcatgagacttattcactacaatgagaacaatataggggaaactgccccgatgattcagttatctcccactgggtccctccatggagggagggaattataggagctacaattcaagatgagatttgggtggggacacaaccaaaccatatcaatgggggtttaagcagaggtctgaggcccagaaaggccttctagaagagtcaaggtgtgagctggaggatgaaaaagagcttgccgacagacaagaggaagaggggcgttctagacacacagcactgcccaagccaaatgaagcaggcgtgaagccaggcacgcccagggggtgactcatctgctgtgcccagagctcaggccaggtaggagggagatccaggggaagggtagggcctggagatcacagaagttctgcctcctgttacctgtaagatccctgctggcatagtactgtgaaggactcaatgaaacatccctgaaatcctcatgatcatcagggctggcattcctgtagcgcttaccatgtatggggtcttgtctcagggccttacccgcattaacatgtttttctttctaacttaaaaaaataataattatagactcacaggaggttgccaagatagcagagttctgcactccctcacccagcttcccccaatggtgacatcttatgtaactgcagtgcaatattaaaaccaggcaattcacatcagtacaatactgttaacgggactgcagattttgtttttgttttcacccattttcaacatactcatgtgtgtatccgtgattctatttactgtttaatcttcacagcaatcctattatcccattttgcagatgggaaaactgaagcacagacagaataaagacagaataaagtgacttgtccaaggagctcgaattcagggaatctagctctaagctactatgcagtgttacttctccggcaagttctggtaactagtgcaaactcgctcatggatcagagatgtttctgagggtactcatatttgaaaaggacttctaggtgtcaaatgtaggttccagacccatcccaaagaaccggatcctcttggaaaagctccccctggccggggctgagcagggaagctgggagagagggcatgtccgcccagggccatggccacagatccccagccttgttggctcctggatagtctctatcccagctcaaaggtgtgcctgtctgcctcatctgctctcaggtttctggtctggtgatgttctcgggactggcctgggctgcctgccaacaccagaactagacaaaaatctgcagttctgagcctcagcccctgcccctggagccctggcaacttcacagaggcctgcttgtgaggccaggaagcaggaagctgggctgctcagccctccgccaacctccaggcccctggctgctggggctggaggagggagagagaaggggacagacaggacatccagtaaagctgtaacaccaccaaaaaaggcctcccacacaagccagccttggcagccagcgacctaccagacaaggcccccctttcctgctgacttttatggagtgttgggctccttggaagggaatgttccctgtgcttagaaatatgtggagatgatctatgcatgtggacagggactgcttagacccatgcacacagcttggtttctagccagatccgtgggactgtgggtgaattctttccttcaacagcattgatgctgctataatgctgtctgtgtaacttaggcaagaaaaggtttcctttcattagaggggaaaacatccaaaccattaaaaaaaaaaaaaagttcataggaatccatgatagcattgggagtggttctgcccagacatggagcgactgtggttaggacccaagaaacagcctcatctgttaacctctccaagactcagtatcctcagctgaaaagtgtggattaggctggaaggatccagcccaaactatgaacctacagggagaatgggaataaggggatataattaaggggcttttatttctattctgtccagagattcaaaatgcagttgcctcagacaggccaggcctcagccatgtgtcaaggtcatcagtgataaatcaatccaccctgggagggtcaggacactggagagggtctgtccagccaaaagaacattagaactcaattgttttaagacactctgcaggccaaaccaaacttgtcgactcactagttactagctttgaattctaaagtcgactcttgtccagaaatcatttcaggagctccaaaatctcaagatcaggagatcctagagaaagattagaagcaacaggccccttgtgtgtggcccttaagttaacacgtcactggctccccagcagggaacctggtgggccctgacttcaggagcctccccaggcccactcatcacccacaaaacagcacccttggggtgctgcagagagggaggaaaagtgcttagtcagcccaccccgctgcacgttgccgagtcagtcatttttttagagccctctagaaaccactagattccaggtcctagaatatgcactacaggcttcccttggagcatgagaagtacctctctgactcccaccaattgctcctccatgaatggcagccatccatccatctgctatccaagagaacgcatactgggtgaaaatgtatgcacaatcagctgagagcaacatgcgaaaccaaattattatctatcccctcccattccaggaaagaaaggcctgtgatgaaagacacagaaacaagaaaaccactacactagtgagagaaaaatcaataatcaaagtgatagaggagaaacttgacaaaccaaagctaacagaataattatgattaacattagatgaggctctgagctccctggtggccaaagcaaaaagggatgctttgtattatataactcatatacaacttgacagctagaagcttagccaaagaaaaagagaaaagttcagtcctggtacgagtttgtcaggcaggtgtgtaggtggcggaggtgataaagtagagaggtgagaggtacccaggtcaaatgcagcctggtgggccaaggtcaggccttggcttatactgaaagaggcatgaggagccacgtggcgggttattcgcagagtcaagacttcatctgactcatgatttaaaagagcagctctgggagctatgctggggatggcccacctggggaaaaggcagaaggagggaggaagatttagagactacagaaaaaagccaggcaagtccttaggagaaaatccattctccttcctaggactgacttacaaagctcagcatgtcctgaacctgcctctccattcaacccaaactcatttctctttccctccctccagctaccctggtctccatctatctcctgccttgtggatgctctttgtcaccttgtgcatttgcacatgttcttccccctactggcatgttcttctccccagcctcatcctttgcatctcagctgaaatgtcagtttcctggagagccatttcccaaacccctatcacaagtagagaattctcgctcccctaactctcaattctagaatcttctgcttctatctcagcactagtcacagcagatcgttattgtaacactgtacctatgtgttggttgttggttttgtcccgtctctctaccaggatgtctattattctaggaagtcaaagataagtctattcccattgcatttcctccagccccatagcataagacttggcacaaagtaggtgcttaataaattatggcgaacaaatggaccccatgaggcagacacagaattagcttcaggttagaaaacggaagctcagagaggctcaggcaacttgcccaaggtcacctggtggtagatctcaagtctgactccaaggctaggccctttgaccctatacccagtttctctgaactcaaattagatgaccttgccctgatcatgcctcggcaagtccctggtaggaggtccttaccactgcattaaaccaagatcttagcgctttgacaaagggccaacgagaacatgaagatgatctgtaaagtccctagaagacgccaggagaagcttaggaaattgcagccgcacctgggtcagatcccaacagagtacaacagcaaaggggcactaggaaatagcccccacctggttggccacactgcctccacctttcaccactcacaacacaaactattctccccgaagcgcacagcttttatctgatcaattttctaggctgtggaaccaaacagtggaatccacaggaaattaagcttattgactcagtctttgaacaccacatggagaagagatatttacacatgtcatcggagccctggggactgtaggttattggcagcatgtatttacagagtttcgcccaacagtggagatggggagaaaaaccaccatgcctccccctccatgcagatttggggaattcagagagatgaaacaagagttaggaccccctgctttttatttatttatttatttatttttgagacagtctctctctgtcgccccggctggagtgctgtggtgtgatctctgctcactgcagcctctacctcctgggctcaagtgattctcccacctcagcctcccaagtagttgggactacaggcacgtgccaccatgcctggatgattttgttaacttttgtagagacaaggtttcactatgttgtccaggttggtcttgaactcctggcctcaagtgatcctcctgcctcagcctcccaaagtgctgggattacaggcgtgagccacagcacccagccaggatccctgctcttgaggctctgttttacttctgcttggctggctcagacagcaggatttggtggtaaagctaattttacacagaccctgttacctgaaagagctcactttgaaaccacaggcagattttttttttttttttgagacggagtctcgctctgtcgcccaggctggagtgcagtggcgcaatctcggctcactgcaggctccgtcacctggggttcacgccattatcctgcctcagcctcccgagtagctgggactacaggcgcccgccacctcgcccggctaattttttgtatttttagtagagacggagtttcaccgtgttagccaggatggtctcgatctcctgacctcgtgatccgcccgcctcggcctcccaaagtgctgggattacaggcgtgagccaccgtgcccggcccccaggcagattttatggagctctcaatgttgcagcaataaactgtgatctgtttccccatctaggtgtttgcctcctgccatttcttcatggttccttgactgtaacttctctttgggtcatttacaattagagaggtgaggcaacctttgacattcttgacggatgccctggaagactggtaaatgaatgcccaaattaaaattaaccacaataaataatggcatcagatgaggcacagtggctcatgcctgtcatctcagcactttgggaggcctaggcgggagggtggtttgagcccaggagttcaagaccagcctgggtaacagagtagtaactcatcactacacaaaatacaaaacttagctgggtatggtagcatgtgtctgtcccaggtacctgggaggctgaggtgggaggatggcttgagcccaggagatcgagtttgcggtgagccataattgcaccactgcactccagcctgggccacggtgggagacgctgtctcaaaaaaaaaaaaaaaaaaaaaaaaaaaaaggcatcaggagctagtatttatggtatgcagtatctctttaccctcacatgttaaatcatgtttccttttgtaatcagaataaaatccaagctccttatcatagcctatgatgtcctacaggatctagctactgcccacctctgtaatgtcccctctcttcctctcactcatcaatatgtttcagccaccacggcgagctcattcctgcctcagggcatttgcacacactattcctctgcctggaatgcttttccctgcatccttgaatatctgtctagtttattcccattgctcaatgctgggatcagttaattacctaccccacaccagtcattacccgtcttgtcaccctgtttaaccattatcacagcaccttttcacttgtttgaagcgttcttatgtatttccttatgtgtttatcatctgtgtcttcttgctaaggtcggtgaagctgagaccttggattttcagatttccagattcccagtatatctaatgcctgacgtgataccaacacatagcggatgctgaataaatactcaaggaagaaatgaaagagagaatgggaactggaccctgggtttacttgatctcactccaaagccggggctcttaaccactgagctacacagcctcatcacaggacactctgctgaatcagcagctcctgttcaaacagctagacttccaaagtcaacaccagcacatggcttttcgggggaggagtacatttcatcacaaggccaagattgtgttttgttttgtaaatcacttcctaagtattaccaaggctcccacaccaatgaatccttcctcctttcctcctgcagggtagaaggtcctggcttggttctccaaccagctaaaggcctgtttcccgcatgcaaagatgatgtttgtgctttagcaaaatgcaacgtcatgcaatcctggggtcagttatgcagatccgaagcactactggaattcagaacctggttccatgaatttgttaactgagtctacagatgtatataatgaacttccagacactcaagacgatgcagagaaaaaccagaaaactatagtgggaaaagcaaggattatgatgacaagaactccatgtggttccatcctgggatctgcttactctttttttttttttttcttcagatgagtctaactctcgcccaggctgaagggcagtggcacgatctcagctccctgcaacctctgcttcctgggttcaagcgattctcctgcctcatcctctcgagtagctgggattacaggcatgtgccaccatgccggggtaatttttgtatttttagtagagacagggtttcaccatgttggcctggctggtctcaaactcctaacctcaggtgatctgcccgcctacgccttccaaagtgctgggattacaagcatgagccaccatgcctggcctctccttattctcttgctgggtgaacttgaatgagctacctccactttttaagcctcagttttcaagtacgtaaaatggaggcaatgactgtgcatttattgggaagggcttactttcaaggccacagaaagaaatacatgaaaaaaaatctatcagaatgcctggaacttataataaatgatcttgaaacatttgttcaatgcctaccatgttcaaggtgcagcacagtaccttgcctgagagattctaagagcatgacaggaagggtcctgtctttattctatttcccaaattccgcatcagaacacataggctgatcaaagaatgggtcagagagtgtgaaacagagaccattcaggaattttttttttttttggaaactaaatctgtgtcacccaggctggagtgcagtggcgcaatcgtggctcactgcaacctctgcctcccggattcaagcgattctcatgactcagcctcccaaataggtaggattacaggcaagcaccaccacgcccagctagtttttgtatttttagtacagtcagtttcaccatattggccaggctggtcttgaactcctggcctcaagtgatcctcccatgtcggcctcccaaagtgctgggattacaggcgtgagcccccacaccccgcccaggaacatctcatatcaagataccaagcctgaatttgaattccagctctgacatttgaggcacccctcaccccatttctgggccttagtttccccactgaatggaaataatggcctatgtcatctggccccttcgtacctctccaccttctcccatccccttttctcagctcccctccccactggaattcctggagtcttcaaccatgctaagcgccaggcagttcgcatgctcttttctttctgcccagaacagcctttcttctggctcttctgggactagctcctcattcaaccctcagtcttccctggccatcctacataacatagcccactccatttgatctgacagcagctccttcttcacttctttattaccactaatcaacatttgtagtgatatatgtattgtttgtttcctgtctctttcttccccagactacggaggttgtaaacattcagaaaaaggaaccgtgcctgttttgattagcagtgtatttccaaaaacctagcacagtgcctgaagcacagcaggtgctcaataaaggcttgatgaggggatgggtgaaagtttggcattccctccaatctatcgcatcaaggccttcatctaacccactatgaagaccctcaaacacaccattcccaatgcttacatccaaaacctctttctgccccacctcctgaggaaatggggcatgagttgtgagtttccttagctgtgtgaccttggaaaagtttcttttttttttttttttgagactgagtcttgctctgtcaccaggctgcagtgcagtggtgcgatatcggctcactgcaacctccgcctcctgggttcaagcgattctcctgcctcagcctcccaagtagctaggactacaggcccccaccaccacacccagctaatttttttgtatttttagtatagacgcggtttcaccatgttggccaggatggtcttgaactcctgacctcgtgatctgcccaccttgccctcccaaagtgctgggattacaggtatgagccaccgcatctggccgaccttggaaaagtttcttaaccactctgtgcctaggttttcttaccacggaaatgaggttaatgataatagttcctgactcatagaattgtttttggcactgcatgagttaacatacataaaggacttcggtaaaatatacgtaaggcacttagcactttttatgccttgtatgtgaataaatgtcatctagggtaggtggagccctgtccctaccattccatgcaggtttccctgagtacctttttttcacacaggtaggttagctcctcatctacaaagtgctcctcaactctgaggcccattggaatcacctagagagctacgaattaccctggagttgtatccatacccacaacatcagactccagtggggcaggctgtacatctgctttttactctccccgggtgattccaacatgaatctgaaattgaaaaccactataaacgcctcatgctcaaaggatctcacaactgcccactgcacactgccctccccaacaaactttactatttttactgtaatagcccacattggacagttcccaaagtactaactagcctttttttttttttttttttttttttttttttttttgaggcagtctcactttgtcatccaggctggagtgcagtggcatgacctcagttcactgcagccttgacttctttggttcaagcaattctcctgcctcagcctctcaagtagctgggattacaggaatgcaccaccacgctctgctactttttgtatttttagtagagatggggtttcaccatgttgggcaggctggtctcgaactcctgacctcaagtgatctccccgtgtcagactcccgaagtgctgggattacaggcatgagccaccacacccagctatctgttctgttctccttagagcagtggttctcaatcgggggcaattttgccctgtaggggacatatggcaatgtccatagacattgtggttccagggatggggtgctattggaatctactcggtagagaccagagatgcttctaaacatcctacagtacctgggaacccctgcacacaaaaaatgacttatccagccccaaatggtatggtggcaaggttggcaaaccctgctgcggagctatcttttctgtgaacttggggaggacagcgcagccttgctaacaatgggaaggaaagaagaagtagtgaagggaacttatcatcactgagtttcaacaccaaacacataccaagcagatgtttcacgaataatgacaatagccactactttctgagcaccaaacaatggcttacaacagaacggaacccctgagttatcttacttaactcacatggcaactctgagttctttgactgtgttttcgcttcatgcataagacagcggggacagcaaggttaggtaactaggccaaagtcacaagacttgtacatgacagatttagattttagcctattctgttaaacttcaaagagaaggctaccccaacagattaatgatgccagctcacacctcctaagcctcacagtacctaccaggcagtgctctgaagacccgacaagtagaaacttaattcattcccatgaactagataatataatcatcatcgtcatcatcatcatctccattttacatcctgggacgctgagacagagtgctgcagtgtcctttgaagaatttcatgcagctgagatagggttttaacaaggggtttagatccagaatctggctcactcccaccatactctcctgcctctaatagagcaatgagcagaaaggatcgaattccagcctgcctcaggacctctgcacatgctgctcctgatgatgtatatgtcttcactctggcctctttgccctgctaactcttttttactcattggatctcagtttatacttccattgtctaggacaccctcctagccctgccaactcactgaccagatgagttatctccgttaaactctctcctagctccccttcatagcatttcacactttaaaagaacccaacacttgtgcaagtgtttggtgaccatcagtctcctcctatagactatagactccatgcagacaggaactgtctctgccttgtgcagtgctgtatctccaggcccctggcatgatgtttggcacaaagggggtgcttgatgaaagcttgtggctgaatgcatgaaacagagaacctaaaggcaaaacagcagctggtgccaatccggtccatttcctcatccccagagagggacagggccatctggcaggtcctagccaaatacctccatggcaggtcagggctgcagagctctccaggcaagctggccatggaggccataaaccaactcctcaaagccatctctgcttcatggtggctggtctttatcattttccaatcaacactggttgagttctaattgattttctatgatatccctctccagaagggagaaaggctctgtttactggggcagtacgtagaggacaggcctattcttcctgctgtatttaatgctgctgctaatcacggagattagactaaaacaattacaacagctaattaaagaacaatgcggtttttggcatcttcgcgcagacggcaccattgggaattcctaactcgggcaaagcagggataattaaaaccccggctccactctccccactccagcagctggatcacgctgattaaactgcaaataaaacacatgaaaccaacactttgtagtctatccaatttcacttaaaagggcttttaactgattcataaacagagaagcggtaaacagcaaattatttaactaaagccagttatttcgtcatcacggttcactttattcccagctccggacttgtacatgtagcccaggggacattaggttgatggggcctgaggaatcactccagagcttactgccacttgctcctgttcactggcaacaggacatcaccagtgtgtagctgctttctctgggttttttctccttttgaaaaaaaaagatcaggtagtgcccaagtccccagatgaatatgcccaggtctgatcagactctgctctcgattctaggtcaagagcagatggcagagacacagaaagttccgaagcgcagataatactaaaagcatcatatgtagctttaaaacatttaacttattcagagctggccaacttcagatctaaaatgcaacccgtatctactaaagtatgaaacagacttgttctcaagctatgggaagacatgtcacaacagctgggtagaaagctcatttgttttagacaggcacactctgagaccccagctcaggtcccatgcacacatgcttcccaactcatcttaacaagcatggtcatggggattgctaattctctctccaccttgccaatccagagacaacaagggaaaaaagtgagaaataaaaagaaaaaggtcaagggaaaaagaaaaggacagaagagaaaagggagaaaatggtaacgctagagacaggctcactgggagcagcaagaagggacagaaaaagaaaaaaataccacaagaaagcagacacagggattttcagagcccagcatgacacatgcggtgaggacctaggagccagcgcctgtccctttgcagtggccaggtatgatggtcacgttccacagcagtgcttctcaaaccagctgtggagaaaggcctttgtatgcccagtctactgcagggtgctaattttgtaaaataaaacaaaaaaagaagcattaaaaataaaagattgacttgcttaggtgccatgccatgtccggttactataaaagctgctgaaagcttgtccttcgtttctgagcgcgtcttcgtgcacacagtgagaaaccctggggatggcactggtccatggaccgacaacgctctgagtagtcctttttgaaaagatcccccacggtcattgggaataaacataatcagattcataggattctatttaatgtgcaccacatgtttttagtgaacaaatgcaggctttcagacacacataaatgtagaaaacaaagaccggaaagacatgcatcaaagattttatttcggaataatgatttcaccgatctttcttctctttttttcaagctttgttataaaatactcatgaaagttatttttaaatgaatattccatttatgaaggcaaagaaagacgatgctttatcataacacgagttatagctatttatatataattatggatgttatttatttataagtatctattatgtggttcaaaaaacgctatgtaactgcatgtagcctcatggaaaaaaaaatatgcagccaatatatatgatgtttgaaaagaatactctgggcgggggtgccgggcacggtggctcatgcctgtaatcccagcactttgggaggctgaggtgggcagattgcctgaggtcaggagttcgagaccagtctggccaacatggtgaaaccctgtctctactaaaaatacaaaaaaattagctgggcataggtggcgtgcgcctgtaatcccagctacttgggaggctaagacaggggaattgcttgaaccagggtggtggaggttgcagtgagccaagatggtgccactgcactctagcctgggcgacagagcgagactctgtctcaaaacaaaaagaatactctgattttagaagatgcttttgcaatttgatcatcaaattgccaatattgacccttttctgaccaatgaaaacagcaatttcatataatttaatctaatattaaatgggatctaaaaggttcccataaatagaggttgaaatcaattatgtagaaaatacacatacacggaaaagaagactggaaaaaaacatacaaaaagctggcatggcgattttattttttccttcttggtcattttccaaatttccaaccgtgggaatatattgccttatgagtgggggaaaaaattccattcaaacatttaattcagagaaattgctagcatttttgagagtcttaccctaatctggctacttactctgtgtctatgtgtactgggagaaagaggataatgagaaatttaaattcataagtattaactgttagatgattattaaattagctcatcatttctaagcatgaactgggcaggaagcatcatgtctatgcaggggaaagcccctatgttcaggagggacctgagatccgtgttccgcttgtctgaatctgccatccattatcctgattgttttcaaacagctttactgaggtataactgacatacaaaaaaaagtgcatgtacttaatgtatgcattttgaagagtctggatacatgcacagactcgtgacaccatcaccacaatcaaggtaacagacatatccgtcacctctaaaagtctcgtgtcccccttttttggtggcaagaacattaacatgagatctactctcaatacatttttaagtatacaatgcagtattgttaactacaggtgctatgctgtccagcagatctccacaacttactcgtcttgcagaactgaaactttataccaattggaaaatgcctccccattttcctctcccccatcccgtggtaaccattcttttatccatcctcctgtgatcttgggcaagtaactccctctttttggcttcagttctcctacctttaaaataaagaattttgaaaggttgacctctaagctccttttgcctttggtattccatgctcttagtccatgatggctggaatagaccccctaagtcatgagacccaaggcaaaataaaaacacaggacctcggcctggcacggtggctcacgcctgtaatcccagcactttcggaggccgaggcgggcggatcacaaggtcaggagatcgagaccatcctggctgaaacggtgaaaccccttatctattaaaaaatacaaaaaaattagccgggcgtggtggcaggcacctgtagtcccagctacttgggagactgaggcaggagaatggcgtgaaccggggaggcggagcttgcagtgagccgagatcgcgccactgcactccagcctgggtgacagagtgagactccatctcaaaaacaaaaaaaaacaaaaaaaacaaaaacacaacaaaaaaaacacacaggacctcttatgcaaaattaattaagaatcttaggatgctgacaacagaaattcaaacaagtgcagagccatggagctgtgtgtgactgcacaggccgcatgtccatgaagccgaccctgctgatggcagaaggccaaggacaaacaccaccaaccaaaataaaaaattctcagttatacaatagacaagttctgaggagctaatggacagcacgggtggggaatgatgtgttcattcatttgtgtaatgtcatcatcacacaatgtatgtgtatatcaaatcatcacaccttgaacacattgaatacattcaacctttatattccaactaaacgttttaaattattttttaaaaagtgtttgagaggccaagcatgtatatttaagaattattcacaaagtagataaaacacctgtcaacaaaaacagccatactcgggttgaatgattaaaaacgagcaacaacttccttttcttttcttttttctttttttttttttttttttgagatagagtctcgctctgtttcccaggctggagtgcagtggcgccatcttggctcactgcaagctccgccccccgggttcacgccattctcttgcctcagcctctggagtagctgggactacaggcacccaccaccatgcccggctaattttttgtatttttagtagagacggagtttcaccgtgttagccaggatggtctcaatctcctgacctcgtgatcccgccccccccccccccccccccccgcctcggcctcccaaagtgctgggattacaggtgtgagccaccacgcctggccaacaactgccttttcataattgatcacaatcagcttctattttataactacgtcttggaataggccattatgcttggatttcacaggcaagtctgcattttcctcgtcttaaattccatcgcggtgagccaaactcagtcaaccttttctgtgctaacatctgtgatcaagattaaagtaactaacagccagctctggctcttgaagcataactggaggataagatcaggtatttgcaaagtgtgaggctccagccacactcctctgcttcaaggacttgatgttgccttgactatcgttactctgaacactgggaggagaggaccatcatggagggagaaattgagtccacctccctcctttgaattaattgcaggagtaaacaaccacagaccacgtaacctccctttcacagagctcggctgtacagaacagcctagaatagtagggagagacaggtgccccgggtttaccaccagagcctatttttctctgtattcatttctaatgaatgagattatttctagggttgagaagcagggccagctgattgtcacaatcaggcatattaaaagccatgataggccgggtgcagtggctcaaacctgtaatgccagcactttgggaggctgatgtgggcagatcacctgaggtcagcagtttgagaccagcctaagcaacatggcaaaaccccgtctctactaaaaatacaaaaaaattagccaggcatggtggcgcacatctgcaatcccagatactcgggaggctgaggcagaagaatcgcttgagcccaggaggtggaggttgcagtgagctgagattgtgccactgcactccagcttgggtgactgagcaagactccttctcaaaaaaaaaaaaaaaaaaaaaaaaaaaagaaggtgtgataaataacactaggcaagaaatgcaagagcagaaaaaaaattatcaaaaaagaggcagatttttattttttaaagggactccagggtcactgagtgaagagctacagcatttttgatgcccgtgcgcaaccatcagtgcttttagcagaatctaaaacctagtgcttgaaatgatggctggattcttcaaggaaggcttcacacacattcagcgtactctatttgagaaggcaggaaaataaatgggtgatagagtttagaaaaattccttaaaagtaaagcttaactctccagaaatgaggctcccaaagcctccaaaacgctccagatggctgaagttttgctggaggtatgcgtgtgtgcatgttcacattttgtagcatttctatgtactgcttttaaaaatccatccttatcacaggccttcttagaacagtggtttgcaaactttttcagtaaagggtcagacagttaagattttcagtttagcaggccacgtgatctctctcacaacggctcagctctgccgctgtagctcaaaacagacatagacgagtacgtaacaaatgggcgaggctgtgttccaataaaactccacttacaaaaacagatggctggcagcatttagcccatgagccgtagtttatcaagccctgctctgccacaaggaacatgggctctggacagggcaggatctggattcaaattatttcaatccaccactctgtaaccgtgagactcagtttccctcttttaccatggggggatataatacattgctgcgtaactgtaaacatcaattggaaaacatagtagatatttgatacatgttaacgtccttatgccaatagtaaatcttttcatcttgctggttttcttagttctttatctatacgggtcttcatccacatggttcttttcagtcaaaaatggcctttctccaacattatctcattgccccacccttttcccctctcatattccacaaggctggtagacagacatcactaactgctctactgataaggaaataaacactcatggaagtagtactccagccagggtagggaattacgtgctccaaaccagcaacctgtgcctccgggtctgttacttgcacaaacatggacacccgtgagtttgtagacatgcccacttggaaatctacacatggacacagaagaggcagttaaccatcacagggaggggcaccaggcttggatcccaccttggtgacatacagattgtgtatccccaggcaaggtacctgaccacacagtctgggtttcctcatttatgaaatgaggctaaaaatagcataggttccagaagtttctacctcaaaatgttgagcgtctaacacctagcccatagtacatgttccatcaatagctgttgaatgaaccaatgtgatggtgagggttaaatgagaacagtattcatagccccaggatgctcaataaatggtcacagctctgcttagtgacaaatctatatgcaccacatatggaggtagatacacacacacacacacacacacacacacacacagctgtcagctccacatgggcaggagccatatctgacacaaagcacttgctcattacaaaactgtgtgttcatttatgaatatacaacacactcgtgcgtataaacaaataagtgcaaacagctgataaactgggttgggctccccaaggtccttgcaattctctctctacatccactcaacccccagaaggagcagaacaggttgatccagacctcagatgatgaaattctgctggctgtttactggattccagaccaccaccacccatacatatcaaagacccgcatcgtttcactccctgggctgtgactccagggtcccataaggtgacccaggctagaggtgccatagaaaatgtccctgctgggccaggcatggtggctcacacctgtaatcctagcactttgggaggccgaggcaggcagatctcctaaggtcaggagttcgagaccagcctggccaacagggcaaaaccccgtctctactaaaaataaaaaaaaaaaaaattagctggatatggtgatacatgcctgtaattccagctactcgggaggctgaggcaggagaatcgcttgaacccgggaggcggaggtagtaatgagccaagatcgcgccattgcactccagcatgggggacaaagcaagactccctctcggaaaaaaaaaaaagaaaagaaaagaaaatgtccctacttaagatgtagaggagcaaggggcagtgatatcctcaatgcgcatatcaggtggcgtttgagcacctgaggagtttcagggactgctgcccttgaattgctgagatgaggttctacctttgaacaaagatggtccgtgcatttggaaggaaagagctgacagatgttccaccgccctgcacaaagggagggcttatgctcaaccaggtcctggccattcccatgggcagagcaggcagccactgggcactgccagcttttcccaatatctcctccgagtccccacagccccttggctctgtgcacaggcgaggccgcctctaaagccaagaaggcaatgacccaactctggaggagggggagatgactcaagctacagcacacaaggccttctcagggccgccttgaccatgccggcctcaatcccaggcagttgccttcaccacaccaaggtagagtactcggcacttggacagtggcgtcagaacaagggtggaggccatgtcctctcggcatgacatcaactaacagcctggctccttggccctgaaagagaatgagccaatgtctgcctctggccatgcaaaaccaatcctcatttagtctgtggaaacagtacatggaaggccagatgtagcctttggcttgaagaactgagtttgctcaacagacacacgttttccattcaacactctttctgatttggttgcggttgtactgctgttgtttaaaggagggagggattaaaccaccctttttgagaggataaatgtgtggtgggtctgtatatgttgatgacagacagatacacacacacatatggtagatgttaacgagcccattttattgatgggcacactgaggattgaccaggtgaatgacttatctcagattgagtccacagccaggactcaaaccaagatataattccactgtccacttttccccaccacactgtggtataaggcctaaaattaatattatgtgctgccttgacacctggggaaagccaagagcatctcatatggcttgaatgtaagtttccctaactactttgcttcctcaaataaggtcctctagccagacagcctcctttgtctcagcaagaccaggtacagtgcctgcctatccctggagagtgggtttctgttccctgccagcctctgggattatttaaacaagacaatcatatccccttgtgggacacagggattattgcatcttcttgcttctgcatagcctgcctcccatggcccctggatgttcaccctgtccccagatacaaccgtgtggccctgcatggtgcacagcacctgcttccctggggctgactgtacgtgacacataaactgctgtccatctggtctgtccagctttgggtgttatccccatagggtgggaatctacttcaaccatggggtgaagtggaggcgatcaaaacacacaccaggctgggtgtagtggctcatgcctataatcccagcactttggaaggctgaagcgggcagatcacttgaggtcaggagtttgagaccagcctggccagcatggggaaaccctgactctactaaaaatacaaaaattagccgggcgtggtggtgtgctcctgtaatcccagctactcgggaggctgaggcagaagaatcacttggacccgggaagcggaggttgcagtgagccaagatcgtgccactgcgctccagcctgggtgacagagccagagtccatcacacacatacacacacacacacacacacacacacacacacacacacacacacggcttcctgagcaaagtgggactattacaatttccacagaatgatattccaaagtccctctctagaggtcagcttgcaacacacctccccacaggtggacactggtcagttttggaagagacaggagccaaggactctggccttcagataactaaacctcaagttcattcctagactggccatttatagtcatccagtagatactccatcattccattgtcactcttccacctgtctgtccgcaggagctccgaattctgcaacctccgcctttccgtgtgtagctcaagcagaatccagagagggcatgagcagtgggtaacaagggcagagtgtttgcaaacccaggaagaggtgacggcacaggcaattagaggcagaaccctgattaactgagcccaactaaccagaaccatcaattaactcaaatcttttttttttcttccctctcaggagactgaggccaggaattgagaaaatcacaatttaaaatggaaaaaaaactgtgttccgggcttttctctggctcaactctgacccaggtccatttccttcatcctcattcaagacacatgtacaacttcaaattttctagtagctgtgttttttaaaaaagtaaaaagaaattgattaatctatttgatttaaccaaatacatcctaaatattgtcatttcatcatgtgatccatatggaaaaagtatcaaatctaaacaaatatgaaaaagcattaaggagatgttttatattcttttgtttgagctaagtttttcctagagcacagctcagttggaactggctgcatttcaagtgctcagtaaccctgtgtggctggtggctaccatatgggacagcacagatctggagctaaagtgtgaagtgattgtttagaatgatgattctggagggttgctagggtttcaacgtccatgtcacctccaaaattcatgttgaaattaattaattaattaatttaatttattttttttttttttgagatgaagtctcactctgccgcccaggctggagtgcagtggagccatctgggctcactgcaacctctgcctcccgagttcaagcaattctcctgccccggcctcccaagtaactgggattacaggcatgtaccaccatgcctggcccatttttgtatttttagtagagatggggtttcaccatgttggccagactggtctcgaactcctgacttcaagtgatctgcccacctcggcctcccaaagtgctgggattaaaactgtgagccacacgcccggcctcatgttgaaatttaatccccaagggaagagtattaagtggtgggtcctttaggaggtgatcaggccagaagagttccgctatcatgcatggggttagtcccttacaaaaggtatggagagaactaagtaaaccccttttgcccttccatccctttcaccatgtgaggtcacagagttcatcccctacaaataatacagtgacaaggcaccatctcggaagcagagagcaaccctcaccagaccccaaacctgctggcaccttgatcttggacttcccagctttcagaactgtgagcaatacatttctgttgcctgtaacttactcagcagcataaacaacttaggccggggctttaaaacaaattggtcactagtgagtaactgcgtgctaagtgtttcctcccaacagtgcctcatgattgacaaactggtcttgggcttacacgggtctatgacgtcctggagtacagactgccaagtcccttctctacagccagggcctttcttcacaggaaagtgactgcagtaagagccacctgccatgacctccaccccattaattacctctttgtctgatttgcaatatgcaagccttctccataccttccacctaaatgatgaattcacacttcagaccaaaaaaaaaaaggaaattatttgaaaaggccatttttctactaaccacccaggaatgtgtaggtgtagcatttaatagtgcctacaaagtccctccccgaggggaccttgcagtctagcaaggacagtgagaagtacacatttaaaaaaagatctactattatcctggctaacatggtgaaatcccgtctctactaaaaatacaaaaaattagccaggcgtggtggcaggtgcctgtagtcccagctactcgggaggctgaggcaggagaatggcgtgaacctaggaggcggagcttgcagtgagctgagatcgcaccactgcattccagcctgggcgacagagcgagactccatctcaaaaaacaaaaacaaaaaaaagatcaactatttatgggtccaataaaaactagctactgggccaggcgtggtggttcacacctataatcccagcactctaggaggctgaggtgggtggattgcttgaagccaggagttcgaaatgagcctggccaacatggcataaccccatgtctactcaaaaatacaaaaatcagccgggcatggtggcgggtgcctctaatcccagctactcaggaggctgaggcacaagactcaactgaacgcggggacgttgcagtgagctgagattgcgccactgcacccagcctgggcgacagagtgagactctgtctcaaaaaaacaaaaaaacaataacaaacaaaaaaaaaactacctactggccacctggaacaagggttaaccaacatatgaggcagccccttttattggtgagaaaaccgagatcagaaaaatgaatgaattactatccacatgctcccacaggaactgcagaagagcgcagcccagaacacaggaagccttcccattttaaaatcattcatcgagtgtaatcccagcacttcgggaggccaaggcaggcagatcacctgaggtcaggagttcaggaccaccctgaccaacatggagaaaccatatctctactaaaaatacaaaattagcggggcatggtggcgggcgcctgtaatcaatcacagctactcaggagggtgaggcaggagaatcgctttaacccggaaggcagaagttgcagtgagccgagatagcgtcattgcactctagcctgggcaacgagagcaaaactccatctcaaaaaaaaaaaaaaaaatcattcattgagtaacttttccattttttgccctatccatgtaatgtctgttgttttatttatttttcagggctctttaaatcagctcatctatatttttacttcaatggcttaatttaaaagggaaacattactcctaaattagtggaaaaactagtataatttgctataaatggaaggtaactagaaaaataaacagagagctattaatttctataaagtctgtggagttatagcttaaaatcatcttgtgagtcaccagtttgcatgtgacactttggaaaaggctgcaacagagaagttgagacctacgctttgcctggctggctggcaagactttgtaaaggaagaagaggaaaggtgtcccaggtgtgtgcacagcatggagaaacgtgcggaggtggatggagggcagagcgtggaaggcagagaggaaactgatacctacctgattaaatcaccgaagcacattcagttccgtgccatggatttaacatggactaacacactttggaaatactttcaaagcaaggtctgcaacaatagtgtttttgtaactcctagttaacaagaaaaacaacagatccaagcccccacggcggttccccagtgtttcccaatactgtcatctgattctgttttctgtcagggaaataaaatatcccatttcctccatgatggtgagttctgaatgcagctgtccacggtcaggggagatggagaggaaagaagccaaaaagcagcaggcaggcaaaggccagtgagaagatgttgactctggggccccgtccttcactactgtgtggttgcgggtgtgggtatggatgtggatatggatgcgtgtacagatgcaggtgtgggtgtgcatgcatgtgtgtgagagagaaaacctcctcctcctaggctcaccccaggccatcaaagagacacacataccttgcagaaagtcaacttctacactggttggggcaagtccagcccgtccgaatcccacagggaagggccaccatggcttctaccccagccgagctgacatccccaaacacagggactttcgtatgtgtgtccgactggccttgctccctgccagtggctgcctcttcaggggccagaaaccctgatcgtgtcaagcagtcctagaaaaaatgctcacccgctttctcagatgaagtgcagtagggctccctggcctgcacaagccagtgaccatttttttaaaagcccttggaaaagaaaggcatatattctgcaacacaatatttggtggacactatcatagcattttgtaagatcgtatgtaaccccaactgtggctctgaacaaaaaaatattattcagccccagaaaggcatataaatccctacaaagtacagggtgggttttttgggtttttttaagtggttaaattctcacaattttttgcctttgttcagtgcagggagacagtggtctgcaaaggtggtaacactgacttcctgagaatcttttttctttgagacagggtcttactctgtcacccaggctaaagtgcagtggtgcagtcatggctcattgtagcctccacctcctgggttcaagccagcctcccacttcagcctcccaggtagctggaactataagcacatgccaccacacccagctaattttttatagagatgagagggggtctcactgcattgcccaggctggtctcaaactctagggctcaagcgattggccagcctcagcctcccaaagtgctaggattacaggcgtgagccaccatgcccggcctcctgagaacctttaattgaacttgcagcattgcaattcagcccaagctccttgggtgcaggacttcacgttgctaaatccagggaagcctaccttggttacctgggaaaatggtgtgggaggttccttagatctctccctagccacctgctccttaaaaacatcacaagaggttgtgggaccacaaacccttgtctccgagaattccttcttctctccaaacttgccctattcacacattcccgatcttattttttcctgagtcctactttgtctgttccacattttttctttttctttttttttttttttgtgagacagagtcttgctctgtcacccaggctggagcgcagtgacgccatctcggctcactccagcttctgtctccagggttcaagtgattcttctcagcctcccgagtagctgtgattacaggcatgcgccaccacgtccggctaatttttgtatttttagtagaaacggggtttcgccatgttggccaggctggtcttgaactcctgacctcacccacctcggcctcccaaagtgctgggattataggcgtgagccaccgcacccggcccccgttctacattttaatggccctcaaatctgtcccctcctttcctttcccactttccctgtcccagttcaggcctttatcataactcccctgaactgaatgtccccttttctgattccttgcctctaggctcacttctgcaatccattccccacgaagcagccagagtgatcatctcaaactgatcttggaccatgctcttctgctcctcaaacatcttcagtggctccccattacctacacgatacatctgaagctccctgatgtggtctacagtacctgggcctgtgcctgccttatcagtcccatcccctgccaaggcctgctcctctcttttacatctgacactttggaaaaggctgcaacaaaggagaagttgaaacctacgctttgccgggctggctggaaagactttataaaggaagaggagccttgtgctccatgaatattgtatttcttgtgattttctgacaaggctcaatattttcatctctgttctctgtcgggaatggtctttcgtgtccccttatcctggtcattcgtggcctgctcacattcacccttttttttgggacggagtctcgctctgttgcccaggctggagtgcagttagttcaagcaatgctcccgtctcagcttccaaagtagctgggactacaggtgcccaccaccacaactaactaatttttgcatttttagtagagacgggctttcaccatattggtcaggctggtcttaaactcctgacttcaggtgatccacccacttcggcctcccaaagtgctgggattatcattcacccgttaaggtcatgctgtgggcaacagctcctccaggaagccttccaggagtgttctaggttatactgcccactcctacatgatcacagaactgataacactccgcaagggagaaacatcagaaatctatcttacaaaaattcaactataaacagtcaggagggaaaaaagagagagatagatggtgacacaaatcatttaaataatgtggaatcctgtgcaccacttgactctgtgagtatataccctgtgatgaacatcttgctatgatttctctctccatctagcccagagtcatttttctggaatctgtgagtttggggatctatggagagagaattctgggggtcttcgaacttgtacatacccgctgatgaacttgtacatattcataattattttcactaactctaactgaaatttagcatgaccttcaattatgaatataggcaacagactgcagtagtattagcaacacccgagactttgacaccaacagaaattgcagatattttcatgtcacattgctttggtggcagatgtctccaaatattgtttatacttgtcattacttcaaaattagggtagttattagacctgatgccaaatctactttaatgtgttaataaagaagcaaatgtattattactccacagttttctgatttttatatatactttgacggctgtacttcaatataaccactttcctttttaatcctctgcatttttttgcatttgaaaatattcagagaaggggagcataattttgaccagattccgaagggatttacaacacagagaaggtgacactatcctgctgtagacagtgagctcactggtggcagggcaccaggtccttcatcttccaatccccagcacctaaagcagtggttagtatacaataggaatttttaaaaaatgaactgagatattttatctatctatccttttttccctccttccttcttccttccttccctccttccgtcttttctcccttccatctgtgtatccatcatcatccatccatcacctatccatccatccattcatccatcctccatccatcatctatccctccatcatacatccatccatgatgcatccatcaccccttgtccacccatccctctatccatccacccatccctctatccatccacccattcgtccacccatctattatccactcatttatctacccactcacctctctatccatctgcccacccatccacccacccatcctgtatccactcatccctctatccatccgcccatccctccatccaacatatatccatccatctgattcaatctacagttctaacagttgacacctctgcagttggtttcccagatccagttctgcagctcaactggagactccctaagaaggaaaagtgactcactgtggaaagaggtgatactatttccttgtatggccgtgggcatgtcacagaatgtgcctgcagctcagctgtctttcacaggctgaacacagagctctgtctccagctgccaccacatgggctggggccccaagctcaggcagagcgccatgcctgtgttcagatcatttccttacccaggaacattttggttttctgctttcgaggtatcacagaatggttaaatcttaaagaacaatcgccaccattaccaattacacaaactgcacagaatggtagttaagagttctgcgtaggtccaaagaccagctccccactcactctctatatgaccttgggtgactcagttaaccctttcctctctgtgcctcagttttgctatttgaaagagggcataacaaccatacctcacttacacaggtttatggggagattaaagagaatcttccttatgggaagactgagttaatccatgcactgcacttagcacaggggctggcacatagtaaatgctcaacaatttttagccatcattatccatcatttcctccaaggaggcagacaatcagaacattaggacccagaatcctgaaaaatggagctatggaattcacaaataccccatgtaaaaaaatgcttagatccactcatatctaaaattcaaatcaaggcagcaagatactgtttttactcattggtttgtcgaagattataaagatggacaatcaccagtgcctttgaaagaggaaacaggaaaccacgtaaggctttgaccggagatgtgaagaaacctcctcataggacaatataaaatttaaaatgcacacaccctttgagccagtgatgttaaatctagtcacttaccctacagaggtacatacccaatcgagcaaaggtgtatttacaagaatggctaaaggcagcatagtttaaaatagggggaaaaaaaccaatctaaatgtctaccaacaggaaatcagtgaaatagatgatgaaatatttagtgcatttaattaatctttattgaacagctactacatcccagagactgtgacaggtgctgaaaacagaactggacaaaatagaaaagttaaaaataacgacgaagaatgatatgtgctgacaggagatgagtgataagatagagaggaaaagcaagttaccataaaatatgtttcagaaaatacatgtcataaaatatgatgttccatttcaaggaaacaggttcctgccaatatgcacatgaatacactcatgtacacatattaaattggtgcacaaagtaattgcagttcttgccattacttttaaatggcaaaaacttcaataacttgtgcaccgacataatacaagttaaaatgcaaaggaaaaatctggaagtagtagcaaaaaaaaaattaacagcagttatctctgaagaataggtataggaagtgatgtgcttttgaatcatttaattgttttcatcatgtgcttgtattgcattaatcctctgtaggtcccgtatgctctatctcctttcagaacacatccagcatcaaactatttcatttttaatttttgtgtacacggagtaggtataaactacttcttttggctttcactattaacactctggtccaaaccacccctgcatgtcccctaacagattacaacatccttccccctcacccatctccctgttcttgcccttgacccattacagtacattttcagcagggcagccaccaatcccattttccaaggcaaggccatgtcattcctctgtttaaaatcctctgaagacttcccagtgtggagtgaagcaaggacccttctaagtttcccaaggttctaatgatctagcttcacctccaccgcccctctctcccttactcatgctgttctagccacaccaggctctgctggcaaccaacacaccaaccacattctatctcagggcctttgccctggctgctcctgttccttcctctttctgcagagctccaccactcatgcttttgagatctttgctcaaacactgctgcatggaattgtctccaccaaaggaaaagggcaacctatctccaactggccttacctagcccacagtcctcccctgctttgctctcccatgctctcatcgccatctgacatgacatatcaacatgcatttctcggttgggcgtggcggctcatgcctgtaatcccagcactttgggaggccgagacaggcagatcccatgaggttgggagttcgagaccagccgggccaacatggtgaaaccccatctctactaaaagtacaaaaattagttgggcgaggtggcgcgtgcctgtaatcccagctacccaggaggctgaggcaggagaatcgctggaacccgggagacggaggttgcagtgagccgagatcgcaccattgcactccagcctgggcaacagagagagaccctgtctcaaaaaaaaacacatgcgtttctcatttactacctgtatagaatgtgtgctcagaagagtaagaatttctgtcatgttggctgttgtatctccagctcctaaaacagtatccagaacgtagtaggcactcaacacatatttattgaatacactgatcaatattatcacatgataatatgatatgctattgataattgcgatgatgaaaagcaaatccagaaaaaaacttcgagtccctaaagaaaaatgtttataaaaacaaaacataaattttgaaaaaacatgtttccagtcacagctgcccgcagagaacagggtggaacacccaacaagaaagtaacacgtaaacacctcacggccaacatggcacacagcagcctggttgtctcaggcagctgctctgcacacaggaccctttcacagagtccagggagtaaatgccagcaagggttgaacatgttacaacgtcagcccctgaagccacagactattttcgggtgtcaggcaaacccacaatctcctgtgacagccaaactactgcagatctgaaaaccgtctccctgcggtctttcaggggacaggcctccgggattgtgccacgaactcctcttgcttcacggcacccagtgcctgctgcatcaacagcgactcaggcataggtgggcttggggtctccatcccccagatgtgagctggaggccctacatccttttgtgcctcaaggttgtgctggcgttttagttttaaaatgaaaaaaaagaataatttgagacaggatctcgctctatcacccaggctggagtgcagtagcgcaatcacagctcactgcaacctccatctcctggcctcaagtgatcctcccacctcagcctcccgagtagctgggactaaaagcacgggccactacacgcagattatgttttatttttttgtagagatggtcttgttatattgttcgggctagtctcaaactcctggcctcaggcaatccttccaccttggcttcccaaagtgttggcattacaggcatgagccaccatacccagtgtgcttggctttttaaatgagaagaggaatcaagagagcgttcttccgtacctcatcacacccacagtgaaacacttggcacatgctatcttgtttgtaactccaggtcacatgaggtcacttggaagcaaaaaattaaagcccaatgacatttacagggaggcgttcaaccagcagacttcacctaaacgtcaccagctccgtctcattacagtcaacgggtgttgatttttacacattctctgctacccatacttggttaggaccgtggttttcagctcaggggtgcttttgctccccagagatattcggcaatgtccagagacatttgtgagacaactggaggagggagtgtcattaaaatctagtgtgtacatgccagagatgctgctaaacattctacaatgcagagaacagcctcacaacaaagaataatcctgtcccaggccgggtgcctgtaatcccagcactttgggaggccaaggcgggcggatcacgaggtcaggagattgagaccatcctggctaacacggtgaaaccccgtctctactaaaaaatacaaaaaaaaaaaaaaaattagccgggcgtggtggcgggcgcctgtagtcccagctactcaggaggctgaggcaggagaatggcacgaacccgggaggtggagcttgcagtgagccgagatcacgccattgcactccatcctgggtgacagaaggagactccatctcaaaaaaaaaaaaaaaagaataatcctgtcccaaatgtcagtagtgcccagatcaagtgaccccaggttagtcagtccacagggtaaacaaggttgccctggggaagggagtcccttaagcactgtagtgaggctggaggcaaaagaatggggttgataagatctggtacaccttggggcttttgagatgtgtcttcgcagccaactgtctaaggattctttttttttttttgagacaggtctctgtcacccaagctggagtgcagtgtggtgatcttggctcactgcaacctctgccttccggattcaagtgattctcctgcctcagcctcccgagtagctgggactacaagcatgcgccaccacgcttggctaatttttatatttttagtagagacggtgtttcaccatgttggccaggctggtctcaaactcctggcctcaagtgatctgcctgcctcagcctcccaaagttctaggattatacataggcgtgagccactgcgcccggcctaacacaggcaagtccactacctggccatgtctgaacataccccaggccagaaaaggagcttcctcagcctgtgggtggcagaggtgagacccaaggggccagctgttggcccgtttttatttccttagaagatgtctcagcctctgctactctgaccactcgtcatccaggcagttctgggcttcactcatgtggtgacgacacagttcatctctgaactgcacgcaggcaaaaaatgtcccagcttgctcttgagacaagcacctagtttggctgccaaaaacatcctggtatttcaactcgtgctgcttccctctctgtaaagaggaaaccagctacctaaacagaggaggaggaacattccagagaaggcacaaagcaaatccctgcagagaatgccaaagtctttgccctctctgtggcacagggatgcaggaggcagtgcatggaggcacggaggctggagagcctctgctccccaagcctgctacttccacaagagagaaaaggcagggggtgacgcagcttgcattcacaagtgacaagagggtgtctccagcttatcctcttagcagtcctcatggctgctttaactagttgggaagctgaagctcagaagctaaaagcctttctcaaaggtgatgcactgagcaagtgaaagagttgggattcaaacgtaggactatgaaagtaatactaagtgcttaggtgccaggcactgttctgttgcttaatgcacgttaacccatctgatcatcccaacaagtctaggaggtggctactgctgttacttcaaccgtttttatttattattattatttttgagagagagtctcgctctgtcacccatggtggagtacagtggcttgatctcggctcactgcaacctccatttcctgggttcaagtgattctcctgcctcagcctcccgagtagctgggattataggcgtgtgccaccacacgtggctaatttttgtatttttagtaaagacggggtctcgccatgttggtcaggctggtcttgaacacctgaccccaggtgatccacctgccttggcctcccaaagtgctgggattacaggcgtgagccaccgagcccggcctactctgaccattttttaaagaaactgaggcacaaagggatcgctggcgtgtggaaggtctcacagcagctaagtggtgagccagggggtctgctgcatagaccatgacctgcccccacgaggcccgttctcacctccccaaggggctgcttggggttaccaggtccagactgcccttgtccactttgcaggtgagaccctaggaggatccagagtcctgagtgtgcaggggacaggacaaacaatacccaggggactgtcactgaggtgaatgaacgcagcaggccaggtggggacttctatgaaccagtgaccccatcccgaggccccatgcaaaggggcagctggtggtcaccagtcatggacatccagcagctcagagtggttttacctatcagtttttcaaaaatcttccaaccccactcttcccctctctaaaaatttaaaaaatttaaaaatcttcctgaggccaaaggcaacccatgtgcaggtcagagatggccacgaggaggcccatggcacaactttgagtccagggccatgaaatgagaaagtcacctcctgctcccataactggtgcctgattctaactgggccagtgaacgtggagactggtcatctgaccaagaactctctttgagcccgttttatagctggaagttccttcttctagcattgagctggctgggtttttccttctcaggacaataaaactgcatttctgtcctcgaccccacccatctggcacctgcaccacagctaacttcagctttccacccagttctcttttgttcagtggaaaaaatgagctacagttcccagaagaaaatgagaacggggttattattaataagatactctttttcagaaaggcagttgaaggcagcggggaagatcacattgaggggggagccggggtagccccactgctactccctcctgcaggaccacctggtctggagaagcagctacgcgctggccctccctgttggctctcagaggtacaaaccagaggtggcggcatttctaagaaattagattcaaatactaggacagttaacatttcctggaggtgtgaccgagaaccaagaaaaagtgattttgtgaaggccttgcttgcaggcagaaataacctgtcttctctgtctgtctgtctgctctgggggctaccggaaggagctgaaggcctgtcccccgcctctccccaccccaccatgccctaggccttagtccctccccactgaagaatgcctttaccaacttgggacagacagaggagtatgaatgaatgagaatactccaagctgaccctgcctggggcatctcttctcacacatgtggcttctctggtgctttatttagcatgagactgtttagaatgtttatttttggctcagttttgggggacagttttcacaaatagaatgacagctatgatcttctctctaaaaaaagagctcgtacaatccaccgttgggcattcagtttcaagagcttcactgtcccatggtctccattctgggacctctcctccactggaagaccctctcctttaatcaaaacatgacacaagatgacagtgactccccatggcaagtcccattggcagtgctgagccagcgaggcgggggcccggtcagggtccctgaaggaaagagatgttactctccaaactgaagagactgtacaaagagattctttataaggaaaactaacaagggaggtgctatgcaccagggctggccacagccaggagctgtcaccaccctggggcctgaaggggagggagtggtgttcctggaccacggagacagtagctgcagccacgggagagggcagccccacagcagctgtggccttgctaggggtacagacacagccaacccatggaaaccctcatctcatctcttcccaccttcctatctcctaccagttcctctacttggccaaagcaaagaaaagtccttgctgatgaaacccatcaaggttagcctctggaggcccagagaagaaaggagaggggtggagagtggatctggggctggggcttgcgggggaagaagacacccaacatgtttcatcttgctaacacccaacatggagacagcaggaggaggcacaaagagggcgtgcggggctgtggatcttccacgctgagcctccacctcccactatccctgagcagcagaggaatcctggtttgctactgagctgctgaacgactgggcaaattgttcagcagctctgggtcctggtttccttccatgtcaagtataaagatggaacccaacaggccctaaggtatgggagtcacagccagcactgcagaagagggaggcctaagtgtgggccctctcaatgccactcccaaactctgtggtcttggaccagggactgagcctctccatgcctcagtgtcttcacttgcaaaggaagggtgtgagagcaccttcgccaagggatgttgttatgaggaaacgaggtcacgcatataaagtgttgagcaacatcccaggcacatagaaaacatgcaatcacccctccagctctcacgttccccaagtttgggccttgtctacggatttttacatccctcatacacctggacctccctcgtgctgctatcttttgtgaaagcaattttcttcattgaatgattccattaactagaacctgcaaacccagcctgaacattctagcatcgaaaccttctcttttaagctccgcagtatgcacagccctgccccaaaaccccatggagaagatcgcttcagcttcaaagatcttggtgcgtgtgctatttatgccaaatgttagtgatgcctcctcgctgagcctccggctcgtaagtcaatgcaaaaccagccacactgccttgttgctcagtggcagcaccacgggcttctgcctcagtgcttgaagtcaatggcggtgggggtgccctgagagaagatgcgtgtgctggaagggaaatgtgagtatggcctcctcaaggtgccactgctgtgctcaccgtctgcagggcaaaccgtgccacagcctggggcttcagctactcatcctagaatccactctgtatggacagatgtttccaagcccatgtgctctggattgccaagtgagtgatctatagcaagcaagatctaatctatatccacatctaatacatatcaaatctctgtatcaataaatagatatcaaatctctatgtcaattctttgtgtcaaatctgtctagatctaatctctaatctccttctatatcttattgatatctctacctatcttgtaacatagcagggaaggagacagatttcatttgtcacctggctctagtttagattctatcacctactgaccgtacaacttttaaaaggaaacttggtctctctggctttagcaggctcctctgtaaaatggggttaaggttagtaactcccagggttatttcccaatatatgaaagctaaactgctaggttcaaatcttgctgcctttgctacctgttgggcaagtaacttaacctctttgcgcctcagtttctcatctgtaaaacggggatgacagtaatacttcccataagagatagttgtgaaatgcaaatgagcaaatccatgtaaagaacttaatttagaagagggactcgcatgcagtataaatgcttaattcatgttacataaaagtgctaaatttatgaatgcatgtccaatgtacagttcccatctcaatgaaacatctattcagtgtatgtaatcattattgacaagagtgatcttttttttttagacggagtctcgctctgttgcccaggctggagtgcagtggtgcaatctcagctcactgcaagctccgcctcccgggttcacgtcattctcctacctcagcctcccaaatagctgggactacaggcgcccaccaccacacccggctaatttttttgtatttttagtagagacggggtttcactgtgttagccaaaatggtctcaatctcctgacctcgtgatccgcctgcctcggcctcccaaagtggtgggattacaggcgtgagccaccgtgcccagccaagagtgatcattttaagtgttctgagttaagggcttaaattcaaactttcaatgtcttcggtgaagtccactcccaacaagaaggggggaatggtgatctcaacacgatctattttttgaaatggtgcatgtggctgcactttggggaacttgctggctatttgcggaatgttgtatcacatcattcaccctgagtcatacagactagagaagatcccatggccaggagatcgcagatcctctctgagaatgactccatgctccaagtccagactccctgtccattgagccaagtctctgcccaggcagtggtctggctggtcacctccctgccccaccagggctaactagagaggcagcaaatcacagccagaggaaaagattatagtaaagcaatctggtccctccccaaactagccttctctgccccagagaggttcttctcccataaggaggctgacgggggaaaaaaacatatgggctgagaagcaatttagtctcaccatcctctcaacagatgctgggcaccataagaattaatgggctggagactcaggtaagagccattcagaagcttcccgattactccaaaaactgctctctgtggaggaaaaggttaatcgaagcccagagccggaagaacggagaggagacagcaattgtgttaatcccaggagaggggaagagcttcacaagaaagaagtttgcacaaacaagcctgtggtctatccctgaaagaagaaccaggcctaaatatcaagatatttgaaagatcttctccatcagtccagagaccttggcaaacccctctccaaaccccagccaagtagctggattaagaaaaaaaaattttttttttaactctgcacattctttgcactagtaagccataaatctcttaggaaaccatctcctgatgaggtttcttctcccataatgatccaacagaactcagtttttaaacacatgatgtacatgttcctgtgtatcatgggtcattgtgtacccagagtcagtcatgtcaatgcaggtctggacacattagaagataaatgtgtcggccaggcatgtggctcatgcctgtaatcccagcacttttggaggccaagatggatggatcacgaggtcatgagttcgagaacagcctggccgacatggtgaaactccatttctactaaaaatacaaaaattagccaggtgtggtgtcacatgcctgtaatcccagctactcaggagactgaggcaggagaattgctttaacctgggaggcagaggttgcagtgagccaagatcacaccattgcattccagcctgggtgacagagcaagactctgtctcaaaaaaaataaataagtaaataaataagatgaatgtgtcacaaccacagcctacagctggttaaagtctgaacttaaaccagaaagggtgatgtttgaacataaacaagagaacaaacaaggaagttgcaattgtatggctggaagtgtctttgtaaaataaactgtcctcagaacaaacgaagttactccagggtttcctaaccttgccactactgacatttgaggctttttttttgggggggggtgctttcctgtgcattatgggatgtttagtagcatccctgatctctacccactagatgccagtagcatccttcaccccgaagttataataatcacaaatgttgggccaggtacagtggctcatgcctgcaattccagcactttgcgaggctgaggcgggcggactgcttgagcccagaagttcaagaccagtcggggcaacatagcaaaatcccacctctacaaaaattacaaaaattagcatacacctgtagtcccaactacttgggaggctgaggtgggagcccaggaggttgaagctgcagtgaaccgagatggagtcactgcacttccagcctggttgacagagtgacagagcaagactctctcaaaaagaaaaggaaaaagtctcaggtgattgtcagatgtctccttggcggtcaaaattgacctagttgagaactactggtttatacttaagtttaagttcagctgaacatcagtcagctaattagctattagccaaatttcagacatcagcccccagctcagcataacattgctaagatctaaagttcctccagccttccaaatgctcacatcagacattagtttcactggatggccctgaatttaagcctctctccttctctcctacctccttagtccttttctttctcccctgcctgataaagtaattctttattcatcttgacattataatgacacaaaagcactgaaggagcaaatgccttaattgaatctaagaataactggcattatttttataggaacccagacatactacgcaaaaaattcagaactctgtcattgggtctttttgcaaggttaacttttaactgtaagctcctcagcacatctcacctcctgggctcagaagctcaaacctcatctctccagctcagattcccccactacctgggagattttacaaccacctccactctacccagtcactctcttacaaacatgtttgtcttatttccatccacttattactatctgaagttacggatgcatttattaatatctatttgtacctttttcatctgactctcctagaatggatgctttctaggcaaggaaacttctgtttttctctgctgtatctttcacagttagcacaaggccttgtctccacatggcccaatagtgatttacggaataaggaaatagatgaatccctttacatagatacaatttctcaagtattaacttccattcatatcactactcatttgctacaggagccctgttcacaatcatcatggccccagcatcatctttaaatcatgtgaatgtcattcccttccctctaacccaagttagctgatcaaagaaattcaagtatctggttggttttgaaaacccagaagttgggagttttcctcctgatgcctttgatctccaggtcctgagggggatctcagcataaacgaagacctgcttccctctaactctagctgagttcacaaatacccagattgacaaatcttgactcggcaaaagagctcctttattatatctcccaacgtatctcagtgtttgagtggaggccattagctaattgacagagagcctgttgagggtgggggaagtgagggcaggaggaggcagagacactagaattaaatggcaagagaccttgccagttggagtggattcagaaatgatcaactgtcttggggatcgatgagaaagaaagaataaagtaataaggattccaatgtatcaaaacactactgatgcgcagggacatgttttgcttttgttcttttaaaataaattttcattcgggtccattgcttaaaccattttacccccaagccctctgacaaactgtcaaagataactcactgcgcaaagcattgaatctttctatccatctacccatcatgcatctctctacccatatatctaagtacatctgtggatagttgtgctaggcactgtctatctgtccgtctgtctatctatggacgttggattgcatataccaagcccatttctccagctttgcctgaatgttagcaaatctttctactagtcaaggcaactttattttcttgcaaaataggaaagcagttgagaagataagattctgatgtcatgcaaccctgagtctaatgtgcatcaacactatctgcttcctgtgtgaccctgggcaagttacttagcctctctgacccttaggtacctcatgtggaaatcgggtatcacacaaacacctgtgtaaccatggcatttgaggataaaatgagagaagtcagttcttggcaaatggtaaatgttagtaagaatgaggataagaataatgccacctagccactcactgaactccttttttatttttttttcatttctaggtcacctgattcgctggcagtcaccatctggagaccagaggagcattcatcactgcaagtcagggcttccttggtgcctccccaggggcagcctgccgagccgggaagctgacaccagggatttaaaccttcctcggcttcctcattctattaatctggccgttaagcagagagtcctgctgatgccaacagatgcaaagctctgctgtgctaatggtaaagagcattagaggagtcctcagcagccaatcaatccatctcccccaactcagaacagctgcacagggacagattaaccaagcgatggctgaggaccgttgcaattcacacgagggagagagggatgcgtgaaggaaagggcccctgcacagccgtgttctaatgcaggccaggtcttggacaagcaaagcggctgatgcattgtgcaaggacacagctctcagtgaaatctaacaggcaggctaacctgtgacagctgggctcaagatggagcaggcgatgctgtccttagaagccaagtgcactgggagaaaagcgggaactgacccagggctcagggtacatctgtcacctaacctctgcagagttaattcttccaagcttggccacatctgccatcttgttcatggcatatgggtaacatttgaggcactacttcctgccagaaagggacctgacccccttgtctgacctgcctgcaggcagctgaacaggatcccatcattcacctcacaatgggctgaggccagcacaaagtcagatctggccacgggcttgtgccaacagtcacaaagaaacatttgcactttggttgggttccaacatctctttaacatgggaaatcagaactcggggagcgagaacaatattcccaggctccccaaagacagggaaccaaatgagactgatggagcatcgtttgcagacaaattgaagctcttccccaatggcatagcacaaatgctgagagtctaccttgtgccattgctggttgcagatggaggttcaggtcccttgggctaacagattggactttaagagtcgccactgtgtaaggagctgctgctggaagcctcaggtgctggccaaagccactggtctgcaactcctctttcccatgagggttttgaagggctgatggggtggtgtccagagtgaaggatacaggaaggtcaaagacagaaccatccagggattctgctgttccactcccaggagataagatttgacttccagagttccggacacagatgttcgcccatgggttttcataagtttaatagggtatccttctggggaaggataaggaaaagaaggaccatcattttaaaaacacaccgtggaagttctctcatagtccctggggtagactgggtagagacacgtttcccaaagggtagcacacacatctctgataggaagtttaggtgacatcagagggtgcgtacaggaacaatattttcacagtttaatatctattttaatgttgtgcaaaaaaatatataactagcccttcaaacttgtggttccatgaatattattgcttgagacagtgtttctcaatctcaacaccattagtatttagggctggatcattcttttttgagaccgagtctcactctgtcacccaggctggagtgcagtggctcaatcttggctcactgcagcctctacctcctgggtccatgtgattctcctgcctcagcctcccaagtagctgggattacaggcacatactaccatgcctggctatgttttgtattttttttcagtagagatggggtttcaccatgttggccaggctggtctcgaactcctagcctcaagtgatctgcctacctcagccccccaaagtgctgggatacaggcgttagccaccgtgccaggcccaggaccagataattctttccagtggggagctggcctgtgtgttgtaggatatttaacagcaacctgggtctccacctactagatgccagttgtaaaccccccaaccagatgagaccaccaccaaatgtcttcagacgttgccaaataaccactgggaatcaaaaccaccccccggtttagaaccattagattaaggtaagtctatttctgaaagcaaagtgagttatgttaaggaaaaatgtatttttaggtgactttatagaatagatgaaatttacataaggcaaaggtggtcaaggtgataaggacagacaaaaccaagccagaggacagccaaacaggcagaggaaaccgaatccttttcctcctcagagctgcaccttctatacttccctgccggccctggcgcctggtcagccctggggcccccgtggctatacctgtgtgccagagaatgcaaggacagaaaagcacaaggaaactgtgaagatctgctggccttccccatcagggaggaagcaaggaaggtctcctcattcctcttaggagaacccaagcagagatgccaaggagagggcaaggacccaaggtggaggaggcaaaggccaggggagcaggtggtcttttccagtccaccccagaaacccttgaaatcgctgagctgtcattcagccttgaaacgttcgaacaggtttgactgtgtctgacacttgcaagctattcactgtggggctctgaacgaggcctgtcctgtctgcctactctctttactgtcagccaaacccaaagagctaaggaaatgattaatccaaagataagaaacgtccccttcagatccagcaggaaaagtaacagttctattggtttaaaaagctgccacttgccggacgcagtggctcatgcctgtaatcccagcactttgggaggccaaggtgagcggatcacaaggtcaggagatcaagaccatcctggctaacacggtgaaacctcgtctctagaaaaaatattaaaaaattagccgggcgtggcagcgtgcgcctgtagtcccagctgctggggaggctgagacagaagaatggcgtgaacccgggaggcagagcttgcagtaagccgagatcatgccactgcactccagcctgggcaacagagactcggtctcaaaaaaaaaaaaaaaaaaaaaaaaaaacgctaccactcacaagcacttagcacgtaccccggactttataaacatcatttcctgtgaccctcaaccacaactctgcaaggtgggcactatcactgggatgacgtttcagatgcgaagacactggcttagacattatgtggccccatgaacactgcagggctagaagacacagaggtggaattccacctggctctgttgaactccaaggcctatactcatagctgctgcactgtcctagctcccaggaaggcagaaagcagacagtcagggccgtgccctcccttacaagacccgctggtcatcctcctccccacacggaaatgccactgcaatcacaattcctcagaatggcctaacacgcaagcagatgaaagggtgcaacttccttccatatgctgccctcactgccaaggaataaaagtcctccaagttcaggcatcaaagagtagcatcttcccacttcatggctctcctctgtctcctctctcctttgcatgaacctccgcatgatggttgggcaggagcgaaggacagacgaaaactcaaaagaaatgattatggttctcgccacaggtgggaggggcaccagacacctgggtgcgaatgtgcacccatgcacacccacaccattgcacacacgtgtacactatatgccagtgtgtatacatacatgtgcaggcacacacacatccaaatgggaccaggggcagccatgggcctgtccagcctttcagagccacgggacaagtccccttgagagctggaatactaaggctgagataagtggccaagacaggaaagatacttacctgagtctccagggtgatgagcggacttgggtgtggatcctgtaggatgaaaggagaaaatgcacgtgaggagtgaaaaaaagttaacttactaccccagcatctttttctttctttcctttttttttttttttaagagacagggtctcgctttgttgcccaggctggagagcagtggcatgatcatagctcactcactgcagcctcgacctccagggctcaagtgatcctcccacctcagcctcccaagtagctatgactacaggcatgcactatcatgccaggcttttttaaaaaattatttttgtagagatggggtctcgctatgtttcccaggctgttctccaacactttggcctcaatgatcctcccacttcggccacccaacgtgctgggattataagcatgagccaccacgccaagctcccagcatcattttcaaacaaagcttgatttccccagtggtcaagccaccccacggggagggcagcccaacctgtgtcctccattctacagagacatcaggacagcttggcccagtctgcaggccgccccaacacttcctctcacgcacaagtgatgaaagaggctcaagtttttatgaaggaaatgcccacatggagatcacacaaaacaacaaaatgtaaagaaaaaagaaacaaggcacccttgccaaagagctcaacgtgtatccaaaccctctataaggagagtttggctccgtaagaggattaggaataaaccagaaagaatataaagtcctgactaggaacaaggccatcatcaatttgtgtctgatcttggaaagaacaagggaaggaatgagagcgagcagcttaatttctggtttgaggagcacattccatggtctggggaaggtctttttttaggatagagaaggccagagaaatgtcctattcattcactctgtacaaaagccgattgactgggaatgcttggtggtactgtctcgggtcattaagcatgaaccctttgggttggaggagagacagggagggtacaggaggaggaaaagactgatgggaggagttggtggtgtccagtgagtggtttccaaagaaaacaggaaacccagcacatgaaggctatttctgtctataccacgtctgctctgaacttaatcatcttggatttataattctgggaaaaacaacctcaagcttcctctgatagagaatgggcatgattttagggccctgaagtacacatccagtttgaagctttgctttgtcttagcagattttccaccacggggttttaggaagccatgcaaattagcaccagcccattgtcccatactgtgagcaagaaggaaatgcagggaaattggaactttctaaaccccttctctaggtgagctgccattcactgtcttgatgactgttctacggtatctttgtaatgatgcccaattctgaggagtgtaagaggcacgatctcagaaatacggtgagctctgctcagctctgtcctttaggaagaggaattcgtcgtcccccaactccaattctgagtccaactcccagtaattctccattggtgtaactgaaaggaaactgccaagagaacatcccactctaattctcacattcccccaggcattgagtcttcctcatacccaagaaaacatggaggggaatatgttctccccgtctccccacattgcagccttgacctataaaggaatctggggaagtcatgaaggagctgttttgggcctgtctcttcaaatccttactgattccttcccaggggtgaagaagtggcagctaggattggtaaaacccgacattcatagagcaactttcttttgatcaggcaggttttgtatcactcgcatgcagaaagagtctactctgtacttcctgtttccctgtgttggggcaggacccatttttgtctttgggaagcaagaccatcctcctggtctgtgggtggcagcatgagtcagacctggtacgagcttagtgggcgagagcatgcaacatctgctgttcaggtcagagtagtctgtgtctgtctgtctgtccattcagatcttaccacctcgattttgattataagataagaagctgcatctcagcctcaaaattagcctcaatctccaagccaagtgctagcaaagcaccagactggggtgttgggtgcatgcccagattaattaagctgtacttcacagaccatttggctattgtctgagacttaatgcttcattgcttagaatctccaagaggttgaagaggggagaatgccatcctgacccctaaaagcagctccaatggacaagactttccttgggaagtcacaggaaatctctgtcaactgtgttgacaaaatcaaaagcctgatctctagacacagtgaagcatcagctctctatttgatgttccaaaatcagagaccttatcagtgcatggtcagggatccaagattaagaagattctggaaagcaaaagcacaaatgctatctatttagcatcttcattaactaactgggaagaagataaagtcctcacaaggggccacatcattaatacttgggtttcacttgccagcatcattatgctctcctccctctgcacacactggaaatggaagactctccctaaagagcctcagtccagaggattcaaggtatgactatatatctgtgaggtctcgctttcagcaacatcctccttaattggaaaggctaacgaagtggaaccaggtcaatgatgctgtctgcctaatccatcctatctgtctaaattgggactctttggtttacagtagagtaaattcctgtccatcagaggaaagcctcctggagaccaaaggggaatttgcaatgtgcgtgcacgctacagtggagtgcttttagaatcttaatgccggtaccagtaaccatggaaccgcctacaacaaggaaagccctttcctatcatctattgcaatggctcagttggggaagtcaaatggggaaccaggtgcactgaattggtggccctcattcgtcacagctcctagatccatgccctctggtcatgtgactcgacagttctttactgtgtgcttctgcagcccttaagcttgggtttgcccatttgactgctttgcccaatgggaggttagtagatgtggcataagcagaagcttgaaatatgcttaggtgatcaagtgtggcctactgtgtttttgccattgccacaagagatcatgtccccagtaccttgctggtccaaggaggatgccagacacgtgaaacaaacctgtacacaatctacagcgtgcagccacgccccgcctagatcagccgaccccctgccaacacagagaaaatatatgcttgttgtttcaagccactgagttttgaagtcatttgttatacagcattattgtggcagtaactgatatactttctaaacactgacctcgatagatcaaaaagtgttgtcacaaacactcacagactcagaacctaaataatacatgctctttctctaagtctgcaaatgcatcccaggaacctgaaattactacagctaacagcgatcatttatagagggcctcctaggtgccaggccctgtgtgctagctctattattacatcaagcaaggaaataagtgaccatcaggatcttgcatgcctctgaattagccttcaatcctgtgtgcccaatataccagtccttctgaatttattatttagataccaacacaacatgacaggaaatgattactcagaatccttttgcctgaaaatacatacagttttcattcctttggtttattcttaactttgtcctatgggcatattacttgactgaggttctgaacagttgaatactagcaataaatgacatttgttaagttctcactatgttccaggcactgggcttaacttctatgcgtgtatcatttcgtttacccctgtaataaccctaagaggtagatactatcattatcactatcattagtatagagatggagaaactgatgaccagagagactggtaacctgtccgagtcacacagatgctgttgaaagcctggatctgatcccagcatcttacactggagaacactgggttccactctttcacaagagctctgctggaaaatatattattactttagacaaaataatcctacaatttttggataatgtctatcaaaatcaagaatacttacagcaaataagcagtaccaccttaacaaataccgtaatctttttttttttaccatctgtcttttttaaaaaggtagcggacatggttgatagaaattagcacacatatcatgactagaaacaaaacagtcactttgccacagcaaggaaccatgtaaagttagctaaatcaatccacacgtgtttactaagttccgattcagtagctagctctatgcgtggcaggcaccatgagggagacagaaatgagtttaaagtgactctgtgtacactgctattcccaaaggtaactgtttaaataagaggcaggagcctgattacaggtcttagagcaatgaaacttgtctacacctcaaaagtcttgcttgtaagaccaagaagccaggctcaaggccaaaggcttaattttaacaagcaattaagccccaacaaagaaagtagagagaggaggaggactttgttcgttatcattccacacatacatcaaacctatctggctctcctggcggattctgagccctgagctaagcctcagccattggaaagcatgttctcttcctttgctttgaggacattcagaagacagtgcttgttctttggtgttaggcaatgacattggtgtagagataatgacactggaactcacgccttcagagccaggtatctccgtgaagcccaccaaatcaacaacatagacaatggacatttacatgctaccttcttccacagacgctcccagggaacacttcagaaggctggcttggtgccttctctccgccaagagccctctaattaaggccagaactgggaatcttccaccatcaaaagatggtgtctcactgtcactcatcatccaaccaccagataacttggaaaatctaagaaactcttcttgggattgcagatcacagcgaatgaaaactcactcatgactcgagcctgctggagaatgtccagctctagccaagtctgaatgaccagccagaaacctaaagggacactgtcacttagctgcaggcctagtagtgcaggacaaagatgaattattcagtgggaaaagagggcaggtttaggggtcgccccagagttcaaaccatacataaccactgtattcatttgctagggctgctataataatacacaggtgaggtggcttaaacaacagagatttatcctttcacagttctggaggttgaaagtccaaggtcaaggtgtctgcaggtctggcttctgaggtctgattctcctcctagcctgtagagatggtggccttctcactgtttcctcacacagccttttctctatgcatcccgggtatctatgtgtcaaaatttcctcttctttttggggtgccagaaatggagtctcattctgtggcccagactgcagtgcagtggcacaatccaagctcactgcaacctccgcctcctgggttcaagcgattcccctgcctcagcctcccgagtagctgggattacaagtggttgccaccacgcccagctaattttttagaatatttttagtagagatggggtttcaccatgttagccaggctggtcttgaactcctgacctcaagtgatccacctgcttcagcctcccaaagtgccgggattacagctgtgcaccatcatgccaggctaatttttgtatttttagtagagatgggcttttgccgtgttggccaggctggtctcgaactcctgacctcaggtgatctgcctgcctcaccctcccaaagtgctgggattaaaggcatgagccaccaggcctggctcaaatttccttttcttataaacaaaccagtcagattggatgagggccccattaatttaatgcaatcacctcagtaaaggccttatctccaaatagtcacattttgaggtattgggggaggaagggtttcaacatatgaaattagggtgggggtacaattcagtccataacaaccacctagcaccacttgcgaccttgggcaaagtccttagcttctgtgagctttatttttctcactgacccccacgtaaacaggtaggattatacttgccaacagagctactgtaacaaagtggaaaacagattttctgggacctttttgtaagggacactattaataattatacaagcttaacaggtataaacccagactgtcccaggaaaccctaagataggctcctctttgtcttgaacacagcataccactgacatcatgagttgtcgtgaacattaaataaaaataaatactgtacatagttacaacctcagaaatgatcttctctttgatttcttcctccaggcttacaaaggctgagacatatccctctatactcaaccctactaaaccacaagtcttctgaactgcaagttaccgtagatacgagtgcaacctatgtcacgtgacggcagtgaactgagcaaatttagctaattcgttttgaatgcttactttatgccaagcatacgaaattcctgcaacgctgccaagggaggtatcatgatccccattttatagatcagataactgatactctcagagaataatttgctcaaaaacacagggctaatcaggaatggagccaggagcagtaagcaagtttgtaagttgccagaaactagtcctttaaccgatatcctggtgttaatcaaaagtatgaacttactgaatcagaatctctgggcaagggtccaaggaatctacattgttatgaaacacccttgggggattcttacgtacgctgaaccggagagactttacatgatacctaaactctaccatgtgtaatgcaagactgaaaaagcttccaaactgacaaagaatacgattcctgcctctgatccccagccagccatcaagtgtcggatgcatgcgtgaaactcttaagagcgttggtgttcacgctctgcacccccaagaaatttccaggacgggtgcaaagtgttcccttctccccactttggtgaagagatttgccttgccctaaaaaacctggctaccaccctccactttccagcatttcctcctcagggaagtgggactctttttcaactcctccttcttagggtctcattgcagcaaccaaggtgttgcataacggggctttctcttcagatgtccccatgggatttcacactggctcctaagacgaaggctgggcacgtgcagggcaggcggcatggggtgatgagggagggatgccagtgatacagaggtgtccttgttctctaaaaaagactgcatttggaatgtgaatgcaggccagaatcacacagccctcaccttgttggaaaatgtgaactcaccttcaaatagggctcaggggagaaaacagaaaccccacagagagaacaaggggattctcaatgttttacagaaacgttggcagttaaaactgggtgtattgcgcgctctctttctctcttttgtattaaaagcttaaaaagctggtctttctgctatcctactttcattctacatttttttagcccaggacccagaaatgagcagtagaaccttaaaatgaagcttaggcccttggagatggcaattcatcacccacagccttggaagatagagaaaccacagactcatggaaacttgggaattatcttaatgcttctccagcttggtatgtgtatccttgagcacaaatggttatcaaaaatctaaactcctgtatttaatactttgttctgtgtgtgcctcaagaggttttgtaattctttaaaaagtacacagaattaccatcttagaattacaaggttttgaagaaacctacctgaaaagattagaggcttgagctacagagtgttaagacaagaatgcccaactggtggcctgtggatgcttcaagctggtttgctttttttttttttttttggcctgcagccttgatgaaatacttgaaatcattcattgccaatgttttaaaaccaggatacttcacatgcaaatctagatttctcacgtctcctttaagaacagaagatttagcaacactggatgtgtattcttgcaagaaaacagctccagactgagtagctggcctggctactgcaagcaacagaatttatcacccccatattaatgcaaattgcctaaggtcacatagctagtcaatattgacaataatcaaaataccagctaacattgttctcacactgaatgccaggtattactgtaaggggtttgtaaatattatcttatttaattcttacaactgtctgggtgttgtggctcaagcctgtaatccgtggaggccaaggctgacggatcacttgcggtcaggaggtcgagactggcctgaccaatatggtgaaaccccatctctactaaaaatataaaacttagctgggcgtgttggtgcatacctgtagtcccagctacccaggaggctgaggcacgagaacagcttgaaccctggcggcagaggctgcagtgagccaagatagtgccactgcactccagcctgggtgacagactgggaccgtgtcttaaaacaaacaaacaaacaaacaaaccaaccttacaagaactccaggaggcaggcaccaaaagccccattttacagatggtgtaattgaggctcaaaggagaagtaattttttcaaactcattcattagtgggtggtgaagccaggatttgaaacagggcatccttttggaccactaagctaccctgcttcccagtggtacaaccacatcttgaactggaatcattaaaccacagttcctggttctatcagcatctggcactaagaagccataaggagcactgaattggatcagatgctcctcatactagatgttctcatttccttgctgcgagtcttcaggtcgactactttgctttttccagtggttaatggtaataatcatcaccatgatcctctcacactcattgtggagcactgactgagatgttctaccagagcccggctcagtcctgacagagtgggtgggccaccaatgttagttcctcttagaagacaattggcgacactttacagtgttttgcttttcacagctcagaggcatctcagaccataaacaagacctgccacgtgccaagaaggcagccgttacccgacatggcccagacaggaagtgctggctaaatcccaccatgccgcaaatctttctaaaggtggccacccaggctgtgtttgaacacacatcctcctggagctgggaacacacgccacatctataattcatcccgataattagcttttcccaggcacaggccgcagcacctatcaattttgcacccacttgctgtggtcaccaagatggcaggtggcccaactggaaccaatactgccaagtgtcccacagacattgtctggagttccaatgatactatgtgacttctgggactgctgggtgagatctctgttccacaggaaaatagttcatatttgagctccagaatccaaaatcgtgagttcaagaaaagcacttagaggtgcagaccagttatgcagcgaattcacaataagttgcccgaggcagctgttactaagcagtccacctggcctcaaattctcaatacggcccgaggagcagatattattaatagattccagtttccctagatgtccgtccctgacctgaatcaaacccatcactgtttggtgaggcatgggagatccaggaggaaaggcctatttcctaagggccacacacagtttggattaaaattcagtgtagaatgtcagttttttgataccaaatctggagttcatcccattttgccaaaataaatttctatgcacatccctccctgcttttcttcacttcctcctcttttgctccttcacaagagcctctgaccaggacatctattgtcgaagatacaggaaaactgtgattcagcagtgcttcgcgtctggaatgactccaagaggccacacacagaactgccgacacaaaccacggggggcggaaaaaacgatcccaggaggtggggagtggagagctttgcagtcccaggctacagctcgggatgtagagctgccttcctaggacagaagagagacgatgagaacacctggctggaaggtggccctgcaggggacggatgggccttctacatttagagtcaggatggagtcagaaagcttcagcaggggagggactctgcctgcagcctgtcccctcaacctcctctaatatttcttaatgaaacgatagtgacaatgaagatgacagccttgatgacagcgcccagtagaccgctatcattggttaagtccttatgagataccataattcaccatttatgagcattacttcaataaacccacattctatcctcatgaagtggctgttcccagaaggccataaagactggatagatagattttttttttttttttggtttttactttaaaaaaaaaaaacgacagggtcttgctctgctgcccagattggagtgcagtgatgtaatcatggctcaccacagccttgaacttctgggctcaagcaatccttccacctcaccctcccaagtagctgggactacaggcctgtgccaccacgcctggctaatatttcattttttgtagagatggggtcttcctatgttgcccaggctggtcttgaactcctggtctcaagtgatcctactgccttggcctcccgaattgctggaattgcaggcaagagtcagtgtgcccagtttgctttttctcttgatgacattaagtatttccttgttcctggattatgaataccctgtagtactgttcctaatttatataggaggaaactgaggctcagagagtttcaaagacttggttgaaagccacagagccaggcccatttaaccttaatatcttcagagaggtttaaaaaaaaaaagaaaaaaaggtaaccaaaatgcttggatgtggtatggtgtgatctgcatggtgcacaaaaatacttctttttttttttttttttttagatggagttttgcttgtcacgcaagctagagtgcagtggcgtgatctcggctcactgcaacctccacctcccgggttcaagcgattctcctgcctcagactcctgaggagctgggattacaggcacatgctactaagcctggctaatttttgaacaatactttttttaaaattaggtgccagcatttaaaatttagggtgaaatcatgatattctgatttgtggcttttcgtgaaatgtggaaagatctgacccactgggtaggcaggtccacttaaggcaggcacatccccttctgtttgccacaaccccaccctgcccacctgggctgagccctgaaagcatctaagtttatgaccttcctatctgttcaccaccataccttacccctcccccacaaaggaaggtaccatgttaccccatgaacatgactccaaccctcacccgccaacctcaagaagaaaaattcgggatcccgtgacttcacagcagaaacagaaaaactcaaataatccatcaggaagttgagcactgaggttaatacacacaggaccatcttcctctagctcaacagtcttgacttttcagggccgtgacccagaagggaggtgcccgtgcagaaggcagaacaggaagaggttcttagcacccactgttttctcttcctgcacagccgccttgggcagctgcctgtgaacagcctggctgtttttctcctagctctctcggaaggaagtgctctcatcacccacgacaacagagttggcccgaggagccaaaaacgtgcaaaggggctccaagcccagctctccttctgttcggggcagcctcagagacaggaagatgggaagaaagtatggcctgggatagaacatcctgcgagacccttacaaagccccagctgtgggggaagggaacaacaggagggggccagaggaagggggtccaggtcacaccaattttatacaatgagctcctttcatccgtgaatagaggactctccttaactctgtctcaatggctttgtttctgaaacgatcaattctacacccagaaagccaaatttgccagacctcatgccaaggtcaggcaagagcctgagatcccccaagcaagttgataatcaacacgcaggagacgacgctgtgctaagtcccatttggcggatccaaagcttacaacgatccgctttcatttctacgccttctgcagtggggcggggttgggggaccctcgctcacatgcatgccacgcttggtggaactgtaggctgtattcaggagagtaagtgttactttcccagggacttcattgagacatctgcggggagggcaggatgagaaagagctggagaaacaagatgcaaggtaaagtgtgtggtctcacactgaacacgttcatgaagtggtgggaagcaaccctagtgactcagcagtggcctctgtttagccagcactttgagaacacgatcttcatgggctgactgcagaggtggccaacagaaactggaatctacaagcagtattcagctcaggcatagtttgttcagcctgcacaatgttttaaaaagaacaacaaaaacctacataggatgccaatacttcacattcaggaggtttcccataaaactgcaaagttctggcattttttggaaaaatcagaagacctagctacacaaatccagcattttcctaaggcactgcctttctggcactggaaagcagctatctcccttagaagggtcacaggccctcctgcttgccacagtccccgccccagacacatgtccttcacttacggctgccagtgtggctgctgtgggcattggtgtttgtaatctctggtttagtggatcctaagctaagcccagcactttcagctggaggacctgaggttagagagaaggacgggatatgaaccatagacaggttgtaaagtaacgtggctgcaaagtccaagaataatttaactcaagaagcacctatgaatgcacacccaggaatacaaggcagagagcaaagttgactcccatggataggggtgagagtcctgtcttctcatcagcccctgctacatacttttgacaacttgtcccacttccccaggaccagggactatcttctttgtttttatgcttaatgaagtcctaagactgccacatagaaagcacttggtaaattcttgctgaaccaaaatcaacggaaacccaattcatgttataggtggaatctgagagatgtatgctgagaactcagccaacttctgagctgtaggatgttttcctgactgtaagtcaaggcaagtcctccctataaagaagagtttggggtataaatgacacagcagaaggagacaagctcaacctactgattggctaatgtctgagatgaggaagcagaaaggttagtctttataggatatgtagcatatctgatgagctatggtctgttaggaaggtactatacgtactaatttcataaaattgaagtatgttccaacttatcaaaggatgcaaaaactccacagaaggaaggaaggacctcatgtggtggcaggtgcagcatattttactgcaacctttctaggtctaaaaaggtaaaatgaggtttatcacatctgcttctgctgtgtatagccatggctagttttctccagctctgtttattaagagacagagagaaagaaagagagagtgtatgtgtgtgaatatgcatgtgtgtacacacacatatgtgagcatccacatgcacatacaggtatgcatgtgtggtctctttcattcaacacccccccaaaaaaagttgctatgggatctgtagattttgtttgctgagtatccctaattttggaattccctctgttctaagttgccccattcttggtactaatttcaaatggctgtgggggaggggaggctagcttcagacaagattccactaagagttttacttctgagctgggatagaagcaggaaagaataacaggaaaaacatgcagcatcccatctctgcactttgcatttagttataattattcacgcaggagcatctttaaacaccaaacgagggaaatattacagttgttctgatttcacatgctaactgtgtttacatgctaacagcatttctcagggacaattatcttattactagtgcactaatcttttcaatcttttcaacacattttacagctgcagacttcaaaaattaaggctaattaagaccttgctttcagcaggtacagtaaactactcacattccaacatggtaaaagaaaatcagtttaggggaaagggtgttagaggggcacagtgtcaatggcagacagaatacattagatagcttccatcagtgtgaggactacaactctcccaatgctaatgttcaagaacaagttccattaatggtaaggcctgtcgaattcaggaccaaggacagctggtctggcccatttttaagagaaagtgggtattttgcattcaattatccgtttccattcattatcttcttccgtgtgacttcagcatagaatagtggctaagaacatggaaacttgtatcagagtctctgtgtacaaatgccggctcaattattttccgtttgaacttgagcaaattacttgagatcttggtgcctcagtttcctcatatgcgaagtaggaataataataatgacatatacctacttcccaggcctgttattaggattcaccgaatatctgtaaagcacttacaacaatgtctgatcataataaatcatcaaatacgtatttcttttaaaaagtgtggtctataaggactaacaacaaacatctgttttctaacacgttcttgacctcacatgtactcactgcattatgggccatttgagggctgctaatatataatcatagctatatttattgtgcctgttagcaatacattctccagttacttgccctgctatctcattagctgccatataaaaccagcaccttggatcatccaatattattttttgttttgtttcgttttaaatcacagagaagcagaatgctctctgaagggctgttgttggaatccatattcacagtccagcttctcagatcccaagcaaaagctctggcatcccaagttgtggcgtctgagaaaccagtaatcagcgtctacagtgctcgggccactgacgttcatcaggcacctactatgtgcctcaacctaggcttgagaggctgctttttgaatgctcacaccaactctgtggggaagataatgctggccccattttatagatgaggaaactgaggcttcagacaattctacagccacaaaacttgtgaataaaacaaagttaccgtgtagtacacgtgtttcattctctccagccacacacttttaagccagctggcggaatttctcaagatgatgaatactattatttttactagctgtagaactcataataatggttgttaccatcaacaccaacatacagcatgtgccaggcactgacatattttactcacttaattctgacaactgcccttaaggaatggactcctattagcctctatttacagatgagggacctgggctcagagaggttatgccatgtgcccaaagtcacacagctgcacagtgttggagctagaatttgatcaaattcaggagatccagcttgagaacactgctcgtgaacactattctccagcctctcgtaatacctataaaattcaacaactgtctccttttcaatggacacataaggtatctttaacaagatagctacagggagtattgattccatcatcttatatcaaacaactgattgcaaaattggtgatttagttagatttgtgataaatgctgccaaaggggagaaggtagggacagaaaacacaggaacttcatccaggagagaagatcagaaaggttctttcagaaagggagaattaaactggctgccaaagaatgagtgagaatcaacttgtccaaggtagaggagaggacaagcattttaggcagaaggagaagcatgaataaaggctctgtggtgggaaggcactcataattttgaggacacaaagaaaggaagtctgaatctagaatcaacattgagaaggtgagtagcatatgataaagtggtaggatttggtgtaggggccaccaggtcagggagtccctttgggtgctaggaaggagcttgagtcttatccaaagagcaacagggagtcactgccaaagttcctgtgtagattgattggaatcttcatcaggatcagccttcactcctactccctagattataatatttggcttttacataatcagatccaaaggtacttctgaaaaccaactcagtgaatcagcacactgaagattttcaaaataagtctcaaataattcctattccccatttttagggatcatgatataacccacacggtctaagacattatgttgctactaccatgccgtactaattattcaaccctcagtattgttattacagacagaaaaaaaaaaacaagaggtgatatcttgtaacatgaaagtcaaaaaaaatcttttttctgtctaaaatagaaggacaaaaaaaatcaatctaggttagaaaacatcaatttgcaagagttctatggctgaggaaaatggcatgagtatttgtaggctgaaacaaatgagcagctaaaacatccccccaccacctcccacacataaccaaatgggacagactacttctggcatgtttccatttactcacacctacaatgtgctaggtgctatggtttatttcaaccccataaccagtgtgaccaagcatcccagcttgcctgggactgaggatatgggacgttcagcactaaaaatcaggcatatcccagaccaactaggacacactggtggctcaacctgcaacaaccacagctattaatataaggcagacacaggctcagagaggtggagacacttgttaatgtcacacagcaggtaaggggcagagaccaagattcaagttccagtccgtgcaacttcaaatcctataataacatttcttaggcacttattatggactaggtagtgctttaagcccatttagaagcattataagcattaattaatcctcgcaacatctctatgaagtacatactattctgggtcttgttttatagatggaaaattcaaagctaagattagctaataactcacccaaaatcccccagccaagagggacctggctttagtgcctatattgttaaccggcccatccaacagacccctgggcaaaaaccctgtcgcaatgcaaaaaaaaaaataaaattttagctgtttcttgttcaagataacatttaaaacacacacacacacacacacacagaaaagattagacgagaggtctggaaaaacaagttgctctgagtcttacagccaccacaaagcaggaattgctagtggctgctgatttacaaggctctctggtgaattacagaaagggaaatacagtcagatttgataaggctggtcaagttcggtgctcaagagcagtccatgatccagagaggccgggaacatgctcctgggccctcgtgcccatcagatcaatccccaccggccaggtggatgggtctgctgttgggacaggcagcctggaaccacatttccacgcttcagataaaggtggcttccggagcccggcctttcactaccatgccctgggggcaccacaggcaaagacccagacttgaacggctggagccactggtgtccctacgatgtatgtgcagggggaggtggcagtgttgaaaagggacggtcatcactgcaccaccattaccattagcattaatcactgagtgtgtttgcttgcgtcagagcctgtactgttaataaaccctgacctgtgtatccaaccactttacagagaaggaagtgggactgtggatcacagccagcgttgccctagggcttagaggggcccatcccactgtgctttcacgacctggtggcagtggttctcaaccaggggggtggttttgtcccccagggaacatttgacactgtctagagacacgcttatttgtcataacttgaaagggagcgtgtactggcacctagagggtagagacagggatggcgctccatatcctacaatgcacaggtcagctgatcctttatccagccccaaacatctatagtatggggctgagaaaccccaacctaagaggacagaggtaggccaaccacagccagccaagcttgcaggttgtgtccttccagacccttcctcagggtaccagccactcaaactagaagccagtgctcaagaggatgggtgatgtctcttttgctcacagctgcatctgaagggcctaaaacagatttggtgacttgtcttttctgttaaagaacagggacctggctgggcacagtggctcacgcctataatcccaacactttgagaggccaaggcaggaggatcacttgaggtcaggagttcaagaccggcctgaccaagatggtgaaaccccgtctccactaaaaacacaaatattagctgggcatcatggcttgcacctgtaatcccagctacttagaaagctgaggcaggagaatcgcttgaatccgggaggcggaggttgcagtgagccgagattgtgccattgcattccagcctgagcaacaagagcaaaactctgtctcaaaaaaaaaaaaaaaaaaaaaaaaaatagggaccaaatgacgaatgaacaagaaatgcacccaaccaggccaggtgtggtggctcacacctgtaatcccagcactgtgggaggccaaagcaggcagctcactttaggtcagaagttcgagaccagcctggccaatatggtgaaacaccatttcttctaaaaatacaaaaattagccgggcatggtggcacatgcctgtaatctcagctcctcaggaggctgaggcaggagaattgcttgaacccggaaggtggagggtgcagtgagccaagatcgcaccactgcactccagcctaggtgacagagtgagactctgcctcacacacacacacaaaattaggtactattctgggtcttgtttttatagatggaatagtcaaggctcagattaactaataactcacccaagatcccccagccaggaagaaggacctggttctagtgcctatgttgttaacctgcccatcaaacagacctgttgggacctcatgaggccagacactaaccccctgtcctcagctagacatggcgatagagttcccattgtctggatggcagaatcttcccatcactgcagtggttcaagacatccaggctctttgtttggcgggacagccagcctgctctattctcaggggaagggctttgagaatggcttatttagctcactccccaagaagcttatcaccccaaccccacccctgcccaacaaacacattcccatcaggaaagctggacgaccctgccttccatggaatggaagctatgatcccatccattcagttcagcctctcataaacgctctgttccaaacataaccagaatagtcagggagtcctcgaaacccagacatgacttattttctatttctagcttaaccacgtgatgcctgtgagtttcaagcactggagcatccccattcacgctggaaccatctcatctagaaaggggagggtgtacaagcagctctggatcagcccactggggttcagaacaagcaaaagaatttctttacctcccctgagtttcagcctcaaagagcagcaaagaacctggagcccattaaatccagctgtgctcattgtacaaagggaagaactgaggctttggaggacaaagaagatacccagatgatctgcattgctctttttctcccttgcttctttctctcttgttgaattggaataggtcaaacctgtctacagtactcaaatgtcacgggggtttcctccactaggcatggggcagagcttattctcaataaatgttcgagaatgaaacgtcagcaattaactagcaggcaactttggagaggatttcacttcccctataattaaacacaacaaatggcacgaatgttgaagggacaatatgcatgggtgtgtgtgagaaagaggaagagactgcagttcccataccaaataggtatttatttgttccaagacttttttttttcaccaaaaaatgctttaatataatcaccttttaaataatatacactgtcatcttgattatgtctattgggcttactcaaagaggccaggaccttgcagagaaatgagcctgaggtttccttctgccaggtcaccagtcaatggatatttcccaaaaggtggatcttttaatatatgactgcataatttaacctaaaatcctagttagtattctagcaagatgtctccttctaattgaggtaatttctaggaatatgttgctaaaagtttccttttcttcaaataaagcaataactgccatttatgaagcacgtattaggtgccaggtacttcactggccttaactctttgtaactcatgttttcaccgtcacgacaacactgtaaggcaaattacgaccagttcacagccaggaaaactgagactgaggcagaaaagtaactggcccagtgctgcagaaccagtaagaggctgagctggggttagaacctaggaatgactctcaagtccaagctctttatactgtattctcctaagctcagattaaaacccactccatcccctactttcttagtatttcttcatagacagaatatttcaaggaatttaacttttaccacaagggatacaaaacaaggaatgagaggacctgtcttacctccgctttatcacaaccactttgcaaagttactgagattcaacagctttgtctgctaaatgggcacatagcccttcaaccactcctttgctttgctgccagaaacaaaggaaaaggcaggaaaaaagtgcatatttcttccagaattgtcagaggccagcagatcttcctgcaggatgtcagcctaagcaatctttcaaatgctccccgggcaggcagcccaacccaccacactccgctccaaggagacacctcctaaaataaaccctgctaacttcagttagctcaccctaaagactatatatagaagaaaagactcaggagttcccatttggcagcagcttctccaaaactcagcgcaaatggctgatttctaacttaatctccaacatctgacaggcggctttaaatcagggaggccgactaagagatggaaaacctctgtgaggccagcccagcctgcctgggggcagagacaccccagggcttttcagcaaactggaatggcatgaaaatgggaacctggcccccggaggatgcgggagagaaattagacaaggtgtggtgggtgggagcaggatccagcccagccaggccactgggcatgttgtgggggtagctgggggtagaggacagtgatctgtacagaggcactgctgtgaattctgaatcttggtgtcttctgggcctcatgttatcctagagaataacagaaagccagggaaagctttgagtctccacatctatgaaatgaaggatatctctctctctctctctctctctctctctctctctcacacacacacacacacacacacacacacaccccttacctccagagagccagacattcactctcaagacacttttgaaaatactggtctttccaaagaccatcatttgtatttgtatttgaaagattgcttaggctgaattctgtaggaagacctgctggcctctgatagttctggaagaaatatgcacttttgtctccattttcctttgtgtctggcaacaatgctaagaggtggttggagggctgggagcagtgcctcacacctgtaatcccagcattttgggaggccaaggcaggcggatcacttgaggtcgggagttcgagaccagcctggccaacatggtgaaaccccatctctactaaaaacacaaaaattagctaggcatggtggtgcacacctgtaatcccagctattcgggaggctgaggcagaagaatcacctgaacccaggaggcggaggttgcagtgagctgagatcatgccactgaactccagcctgggcgacagacccagaatctgtctctaaataaataaataaacaaataaataaaaataaaaagaggtggttggagcgagatgtgcccatttagcagacgaagcagttgactctcagtaactctgcaaagtggttgtatatcccatggaaggatatacaagaaattgttagcaatgattcctttaaagacagagactggaaaagaaggagaagtctcctattttatatccttttctcatgggggaattttgttatcacatgcttatactccttatatttaaaaagcaagtgtcattcacagatggagggataataaggtggcttctcaaaaaattaaatatagaaaaactagatgtcaaatgctatataatcagcaattcctcctctgggttcacaacctagtgaaaagaaggggcttgaacagctattggcatatctgtgttcaaagcagcattactcacagtagctaaaaggggaaagctagcctagtgtccctcctggaagatctgcgtggataaaccaaatgcaatacacacataccatggactagtcagccttaaaaaggaaggaaattctgacacattccgtgacagggacaaacctcaaagacattatttatgctaagagaaaccagccagttacaaaaggacaaatactgtgtgattccacttataggaggtacttagcgtagtcaaaatcatagacacagaaagaagaatggcagtttccaggggctgggggtgagagtggacaatgaggggctatactttgttgtcgttgtttctttttttgtttgttttggcctgcaaagcgttttagaacttttcaattaatcgctaatgtttgaaactcagaaaatgtaaacaaatctagagtgagagaaagctcatcagttgtttgcctgtggatggggtttggggaagagggaggtagttattgtaaagagaaataagaaaatcctgggggtgatgttcattatatccaataatttggggtgatgatgtcacaggtggatacagatatcaaaactcatcaaattttacactttgaatatgcataatttatcacaagctaattacatttcaataaagctggacaattttatttatttcatgctattcaaacaaaaaagaaaaaaaagaacaaataaaaggcaacacctttttttttttttttttttttgaaatggagtctcactctgtcacccaagctggattggagcgcagtggcatgatctcggctcactgcaacctctgcctcccagtttcaagcaattctcctgcctcagcctcctgagctgggattacaggcatgcaccaccatgcctggctaatttttgtatttttaatagagacggggtttcactatgttggccaggctggtcttgaactcctgacctcaaatgatccacccacctcagcctcccaaagtgctgggaatacaggtgtgagccactgtgcctggtcgcaatatcttaataaaataaatggagattgaattattaatagaaaatgtctaacattttagttctgacagtctatgaaattgattctaaatccaaggaaacattacagaaggagaaattaagatttctaggaatgaatttatttactcaactaacagtggcaatggatgtgggctaacagtgcacttcaactttatctcagttaatcctcactgcaagcccatgaagcatctgttggtattttccccattgaacagatgacaatactgaggcacagagaggccaccttccagaattgggatgagggcagggatgattccagagtccatgctcttacccactgtgccgtgccccctccctcaattgtcattggacacccactatgtgctgggcactctcttggctagattcacagtgagagaagccactttgggccaaaaggctgcaagaaggggcaaatggagatgccggtatttgggcctctccatctttctggggtggaaagtatcactgcacatcatcacaggtacacggagagctccacggtgggcccatttcagcaagaggcattttaaggtcccaggaattgtccaaggcactgctgccccataaaactttctgtgatgatagaaacagtctctgtactgaccccagtggaactcactagccacacgtggctgcccaccacttgaaatgtggctgttacaaatgtggaattgcatttctaattctatttaagattactgaatttcagtgttaatgggaccccacacagagtggattgcacagtgtcactgtgtcagcagagcacagcctggagatcaaagcacagcacaaaggttggcatctcaggactcggggcaggccagccaagagtgcaaccagcacagcacatgggagatgaacttggccctacagaggagccagtgtaactgcctctgaatgcccccttatctacgtttgagtcaaccaggatactgagggccatgtggaccacaacacacatgctccagataacagtccccatactccagataacggtccccatactggcactcactatcccagacgtctcgtgcaagacactttagtgcattacttcctagagaccgcaagaaggagtaactcccatccccattacccaggtgaggaaactgaggtacagagaaatgaagcaacatactcaaggtcacagtcactggcaaagctgggatttgaacccaggaggtttgactgcagaggacaaatttcaaacaactacccagtcccatctcccaagacagagtcacaccatgccgcctgtcctgagacccacgtactcacttccaacaagctgcaggcagaggctttccttttggtgggaggagaaaagccaggcttcccatggagagagtgagaaagacacagtcacaatcccaagcacagggacagaccgttccttctaaaccaccgtcactagccacaaacacaggaaatgcacagcagcttcacatcttcctcctcattttgcacggcccattctctctgccaggaatcccttcttctcttgcccacctggaggattcatatttatccttcccaattcaagacgttttattggaaacctttcctgacctccgaagataagtagaccactccctcctcagctagctggttgcggtcactgccaccacgactctatcctgtaattacttctctctaagcacccatcttcctcactccactgtaacattcaagattccttgtggcaggggctgggtcttatccacttgttttcccagagccaaacagggtgtctgacatacggtcctggctcggcaactgttgacttgcaatggcaatgataagatgaatgatttcaacaaaaggaacatttacattttaagagctgaatcaagaactcgcttatgtcaaagaaagagactagtgagtatccctcaatgtcttgggcactggaaacaggccagggtgtgttttccaactcagctactttctataatagctgtgtgacccaaagtggaattttcttttttttttttgagacggagtttcactcttgttgcccaggccagagtgcaatggcaagatctcgactcactgtaacctctgcctcccaagttcaagtgattctcctgtctcagcctctcgagtagctgggattataggtgcccgccaccacgcctggctaatttttgtatttttagtagagacagggtttcgccatgtgggccaggctggtctcgccctcctgacctcaggtgatctgcctgcctccacctcccaaagtgctgggattataggcatgagccaccgcgccggcccctaagtgaagttttaacctcttaaagctttccggtttccctccataagatgaggataacattaggatcggcctctgggggttgctgggaggatcacctgggctaataatgtatgtaaaacacttggcatagaacctgggcttctataaagcagttccagccctgggcccaaaggatcagaatgaaagcaaatgagcaggtaggagttgatgctgtacaaccaatcccaggtaagtaggtggttttgccaatttcttctcctttagtcccaccaagttctgagagaccctgggcccattctgtctctcggctggccagacccggttttcaggggccctcagaaaagaggtcacccactgatcacctccctagctgaatctgactcttatatattttgttttgaactgcaaagtgtttttaaatttttcaattagccgccaatgttcaaagctcaggaagactgtgcattcaaattctggatgtctaaccttctttgaaaaattagatttggcctcactgggttcatactttgaattgactgaatctgagaggcactgtctacttcagatgtggtgtgggagtgcccagtccccatgtggccaggacacttgttctcactaccaaccctgcccagaaaacatctaactttgcaactcctgccctagggaaggaagttggccagaaataggctgttttatttagcaaagctattagctaaaagcagggagcagctccgagggtgagtaaaaatccgcattccaaactcatctgacttctctttgacagcaccggtatgtaaagatacagatgaattaatcattccgtttagtaataaactaaccctgttgttgctgcctctgtcatggagaaagcaaaaaatcaatcgctggtggaagcacttctcaatctacacctgacagaggggcgacagttagtgctgtcctattcccagcatcgggcctggaggaattcctgattttaggtgactgcagagtccttgaaggaggtaaaagctgctcacagcctgacagttctctgcatttactcccaaagaggagatgacggagcagagagacatgatccgatgaagagacaaacctgtccatgtcactcacctttatgtcttattggaagtgtcacctcttcgtagatgtgacaactgaacctagtaaatagaggcccccgctgcctgccccatccccataacacacataaacacacatacacacacacacacacacacacacacacacacacacacacacctatgtactccactgttggcctccctggaacatctgccagaggctgtaatatcttatttgttctcttgtgtgctcttttcagctatattatatgctgtacgaagaaagtagccttgtctgatttgatctgtttccagctacttgtctgtttctggcacctcacatagcccttggcacccaacgagcccttcctgaaaatttgcaaatgcatttttgacacaatacacggtattctgtaacgtttccaaacttccaatgcccatgcactagtttcacggtttttgccatatttctgtaccacccagtccagtaactcagtattttcttcaaccaactctcatcttgtagtgaaatagatctctttttaaaataaagctttacggccatgcatttggtcaatagagagacacctgtaattgatgagctctggagttgacagtcacctatgagcagtgtgaccctggacaagtgagttaacaacagtctatgaaattgattctaaatccaaggaaacactacagaaggagaaattaagatttctaggaatgaatttatttactcaactaacagtggcaatagatgtgggctaactgcacttcatctgcaaaacagcactaacaatagcacctactgaatacagaggtggttcaagggtaaatgacttaaaacatgtaaagttaatttacggcaagtgcttccaatagtgcctgccacagagccaacacgatatgaatactgcttgtattggtattatttaggggggaaaaccggtatcgctttaaataaatacatgacaattaaaaaaatcacttatgtaacagctgagaaacacttttggagacatgggctaagcctgagttttactgctacccaaatgtgaaaagcacccccttcgccaggtcctcatctcccatcttttaaatgaagatgttgggccgggcactctaagattccatccatcttccagttctgaatctctgactctcagtcatggataacactaccttaaaagaaataaaataggaaaaacctgaatttacacaataagctcaaaaggaaagagctggaggcggggaggttattcacattcccaaaggatttgcttttacaaagggattaacagcagagttgctttaaatagcagcttaagccttgtttatggattactagatacttgatggagaggtggaggggctcaggaacttggaacaaaagctttactacacccaggcagaaatgaaaaagcgcatatgttttctttaaaattacaatacacatcaacaggagaaatgattccatttcaaggaagctgattcctactcagtatttccgttgcatgtcaattgcatccaagaagatatgcctgtatccacgagccagtttagagcagtaatccagtgttcatatttttaagcccctattataagagcactgataatttattaaatgtcccaggcactgttgagcatatgacatgcattacctcatctaatcttcacagtaacccaataaggcaggtgtagttgtcatcatccttttacagatgaagaaactgaggctaagagaggggaagtgactcacccatgtcaaaagatggcaaatttaatagtcaagccaaagcgcatgaacctggctctgaggttagattataaaaggtaagatccttgtctcaaagagggcacagaacagccacggaggtcaacagactcagaggaggatgataaatgccccaagagacacctttgagggagcagaagaagaggatatcaaggtctagggtgtgcccaaagccaggagtgacctcatctgacccccaggtgtccatattcgagcatctctaaacactcagtgtatggattcctctcctccatccttcatgcatagaccctcttatctgtacctccctatgcacaaaccaatgtgtcctaggccactctattcccgaaaggtgggctgtgggactggaggcaaagagagaaagaacaactgttgcagggtctctgccagcacccacactgcttcactagactacctgagagcttcccattgcctggttttcctcctttgaaaaatggggatattcgccaccccccacctccctcagcagggaagcactagtgattaattaggtaacatctgtgaagcactcccagctttccggagaagggcaccttgggagaggagctataaaaacctgaggcacaggctattatcagcgtgatcattattatcatcattgtcattatgacattctcctgcccaaagacctgcagtggctcaccactgcccagagaagaaggtgccattggctgcctggcaggcaagggaaccgctgctaccccctccctggactctcccacccccatgcatctctaaccaataataccctatatgtgagtcctgcaacttccacatggaaccccttctcctcagagcagctccagtcttgcccggtccaagaacctttcctaaccacgtaggctggaagctcaacattggcatgcctatttctgctgtagacaccaagatttttctcctcgtgaagattctattcagaggaatacacaagtgcataaaaaacagtgatattgcatgagtttctcttttcccagagctataaaacaaagatgctacacaaaccatgactcagtatcttagactgatgctcgtgacttataatgggttagatccaataaacccaccgtaagctgaaaatagcctaagttgaaaatgcatttaacgcacctaacctaccgaatatcacagcttagccaaccctgccttaaacatgctcagaacactgacattagcctacaattaggcaaaatcatctaatacgaagcctagtttataatgaagtgttgaatactgtacatggacattttgcagacatgacaggatgctaaaacacaaaacacactatccaaatacatcgctagcctgagaaaagatcaaaactcaaaattcgaagtaaggcttctgctgaagatacatcgctttgcaccaacgtaaagttgtaagtcaaacccactgtgagtgactgtctgtgtctctgattagatgataagcatgtagaggaccagagagagttcagataaagtctacaattcatgaacagggcctcaggaactagttaagggaacaagcacggtctctgggttcagacagaccagagctccccattctgcctgtcaccacctccctgagccccaacttcttcctctgcaaaatggagaccagcatacttaatatgaacagttaaagaaaaaactaatccggattaagtaaggagaaacatcattggaaaggattattgcgaagggcagaaaggaaaaatcacactacggagggtgctttaccataagatcttaaggatcctgaagcatctcaaaggctaggcaaaaaggagttttcttttaacaaaaaggagaaacaaaagcaggtttggggaagaaaggatggtatgatcagagagtagatcagagaatgttttaccctgatgccagccttttctcaggaggggctgtgtgctggctcacgctcagtgtgggtcaaggcaaaagcacctggaggaagaagagagtctgatccaaagtctggtgatcaagcatgttgttctgattgatcagtgggaatgagcagccagctcatcctttataaggtaacaaatgggaatatgcagggtctgggtctagccctgtcctggggaaacaaaagggtatccacgagttgtagctaagtcacgtgggcaacactggttctttgcagcgaggcattttctgcaacacaaacaggtgagtggattcctttaacctttgttcttttgcaggagcacagggctcaagtaaaattcagcattgttgatccccaagaaagtggctgtgtagattcaatgtgccaatgcatagaaagcctttaacaaattgagtttttatcatttttatttttcttagagatagggtttcaccctgccactcaggctggagtgcagcggcacgatcctggctcacttcagcctcaacctcccgggctcaagtgatcctcccacctcagcctcctgagtagcgaggactacaggtacacgccaccacacctcgctactatttttgtttaattatggtttatctgcaggatagtatagaacaatcattgtaagaggcagaaggttgagaaaggagtacagacattctggaggtgtcttgcaaataaatatgcagccccggagtggatctgtttagccagccaggcatagaacacttctgactcacactggactttctgtctgatcagccccaggccatttttacatcatcttctcttaagcaagacaggtcttcagcctaaaacacatccaacatagtccctggcgattgagaagttcaaagaaaaataaagtgaaatatacagcccaccactgcaatccatccaagaatcaaagggtgtaggcttcaagacaggatggagaaccaggagttaaacaaaattctccactaactttttatcctctgctataatcagtggcatgcaaacctgttttaaatttaccgacagcttaagctgccacccaggtcttgaggtatttttagtcaactagaaattcatttagagcctgaagtcagggaagggaatcgtgtcaggtgtggctcctgcaggattcaggtcgtgccctgtacctgctttagttaccactcctcatttgcacacaattaaataatcacttcaccccctgcccatctcttcagcatcttcagcatctcctcacaaagcagcaggagaggggaataaaacgtcagggaagtcaactctaggtttaagagatctgttcttaatccgaacatcatttccattagcagaaacaaactcaacagggggaggcgagtacaaggaatatagggccctgagccgaaccaaaagagaacaaattcctctttccccactcaaaacaggcctatccaataaagttgcggctgtatgtacgtgaataagctgccagcaagaacgaggcagacacaggaggaatgaaattaatacttcggggtggggagtggtaagaaggtgcctaagtcgaaagcaaaaccacccaccctagtgtacaagccaagcatggaggaggcaccttcaatgcctctttatccttcaggcccctgtggccaacacatctccaattcactggtaagtcaacagagtctgtccagaacttgaaactgcctttgcaaaaacggtaacagtgagaaaattatgacagtgaaagaggtctgatctaaccaacccccatcttgcctttacctccaaaccgctcatgatcattcctgggcttgggtcaagctaactttcagagacatttagtttatactttaaaagataacagtccttccccaaaactaaaccacctttgtaaagctaatgtaggtccattaggttacaaggattaaaaggagccttggccaggggcagtggctcacgcctgtaatcccaacactttgggagcctgagattggtggattgcctgagctcaagagttcaaaaccagcctgggcaacatgacgaaactcccgtctctactaaaaatacaaaaaattagctaggcatggtggtgcgtgactgtaatcccagctactccagaggctgaggcaggagaatcgcttgaacctgggagatagaggttgcagtgagacaagatcaccccattgcactccagcatgggcgacagagcgagactccttctcaaaagaaaaaaaacaaaaacaaacaaacaaaaaacctgaattctgctagtgtaaaggattcccagccattattcctgaggtcacaagatttgcaacttccctgattcctcctgcagataacatcactcctgtagaacctaagattggccttttgagatgtcttttcaggtttttgcatttcttttatttaacacttgatatgaactaggggaagatttttacatttctgactatgatggcttgacccagacccaccaaccagtactgtgtcctcaccagaagaggaccattttccacccacccctgtgattgcatccccaaccaaccagcagcacccataactttgtccgccaaactatccttgaaaaacactagcctcaaaatttccagagagactgatttgaatcataaaactccagtctcccattcagccagttctgcatgaattaaactctctctattgcaattcccctgttttgataaaatcagccctatctggacagtgagcaaaataaacccactgggcaattacaaactgtccacttctgaccttgaccaccactatgctaacccaagtcccagtcatcttggatcccaacatccctttactcccagggtcctttcttcttccagcagccatcagaggcattgatagggcttggctgtgtccccacccaaaactcatcttgaattgtagctcccataattcccacatgtggtgggagggacccagtgagaaataactgagtcatgggggtagtttccccccatactgttctcatggtagtaagtctcacgagatctgatggttttataaggggtggttccccctttcacttggctcttattctctgttgcctgcctctacgtaagatgggcctttgctcctcatttgccttccgtcatgactgcaaggcctccacagccatgtggaacgttgagtcagttaaacctctttcatttataaattacccagtctcaatgtctttatttcgcagcatgagaaatgactaatacaggcacccttataaaatcataaaccaaagaacatacaacatagcaatttgtaaatcctacatgacttccccatctccctggaaataaaatctaaacttctctccttgatcataaagccctataggatcttacccctgcctgttcctcaagctcatctgacaccatgcttccttcttcctctgtgctccagcaccgatggccaaaggtttctagaacattccattctctctgccgcctcaaggccatttccctctgcctgggaggtttttcatccaagttttcacatggcttcctggtcgttgaggtctagggccaaatgtcacctccctcagggctctcttgggaccaccctcttcaacacatcctcctattttaatcccatgtataatatttgccatgttaacaggttctactttttttggtctgtttgatctctgtgtgttattcactgctgcatcctcatcgtgcacactagctgatactcctaaaaaatatttattgaatgaataaacgaccatcggaaggagaaaggaaaccccttctctctcaggaccccaaattcactatgccaaatgggagagttatgcttggaaactgagtcatgcaaaacactgcctttccctttgttcctaaacagacagctgcaagacagaaggccacatatctctccaggtggcctccctcgccttgacaatgtaaattaacagcttatcttcagaggtatgggacaaagacaagactagaaatcatcccccactgcccaccctaagacaaatgtatatttgacgtttccctccactttatgtttactttatcccatgtaaaatacagatttactgagcttgagacaaatatataagtgactgttcccctaccccctcctttcaaatgcaagatgtgggttcggtaagagttaattaaagcctcataagaatgtgacctctcacctcactccctaccttccctcttttctttccttcctccttcccctcctgcccactttttcccctttaaatacagagtcctcaaagccctctttggaaaaagcacaggccagatcctccagcgactttcatccctttttcctggggatgtcctcaaccttggcaaaagaaacctctaaactgattgaggcctgtggcagacactttggtttgcagaagaaaccacaactgtagcacatgatgtgagcaggtggatctgaaggtgatggtgtgtattttacatgacggcatacctcaatgtgtttattttttatttctataaatgtaaggggtgcaggagcaattctgttacatggataaactgtggagtggtgaagtgtgggcttttagtgtataccatcatccaaacggtgtacattatacccatgaagtaattctcatcatcccccccaaccaccctcccactcttcacagtctctagtatctatctcattccacactcaatgcctgtgtgtacacatatttagctcccactcccactgatgagatcatgctgtcatatctcaatgtagatgctaaatgttcaccagcaatacatgctacatctttagagttcggaaaaatgtcatatgagtctgggtgtggtggctcacatctgtaaccctagtgcttttggaggctaaggtgggaggactgtttaagcccaggagttcaagaccagcctgggaaacatagggagaccccatctcaaaagaattaattaattaattattattattattattattattttttgagatggagccttgctctgtcgcccaggctagagtgcagtggcgccatcttggctcactgcaagctccgcctcctgggttcacaccattctcctgcctcagcctcccgagtagctcggactacaggcgcccgccaccgcacctggctaattttttctatttttagtagagacggagtttcaccgtgttagccaggatggtctcgatctcctgacctcatgatccacccacctcggcctcccaaagtgctggcattacaggcatgagccaccacgcccggccaattgatttttttttaaatgtcaaatgaagtaaattctcagacccaagtagttccaaatatatttaataactgaatcaggtatcaggttttaaattaatgaaaatgaaataaaagtaaaacttcaatttctcactgctctagccacatttccagggctcctgatatagccccatgtggctgctggccacctcactggacggtacaggggtggctcatgtcacccaccacagcagcgatcaccgttgcagttcacggagaacagatttctactctgccttcatggaggtatcttctccatgggaggcagcggtggtctccacacgatccaccaagtccaaccctgccagctttttcattctgctctctcagagaagctgatatggcccagtgattccaatagggagcatctgggcagagtgccctggaggcagcagtccatcctcactgacatacagcacaactttacccactgtgcaagaagcacctgagcttccatgtcagaccatggaggaggacagcatttctggagataaataaagccaccacgcttagagaaaacaacagaggagggtgggaagagctctggccctggagctagaccgcctgggtttgaatcccagcagtgctactgaccagctatgtgaccttgggcacacaatttaacttctctatgactcagtttacctataggcaaaaggtcagcacctaccccttagaggagttgaaaaggacaaatgaaacagagtatataaagcatttgttgggctgggcatggtagctcatgcctgtaatctcaacactttgggaggccaaggcaggaagatcgcttgaggacaggagttcaacaccagcctgagcaagagagtgagatccctgcccatcccccctgtattagtccattttcacactgctatcaagaactacctgaggctgggtaatttataaagaaaagaggtttaactcactcacagttccacatgggctggggaggcctcaggaaacttacaatcgtggcagaagaggaagaggggcaaggcacatcttatacggcagcaggagagaatgagagtgaagggggaactgccaaacacttttaaagcatcagatctcatgagaactcactcactatcatgagaacagcatggggaaaacctcccccctcatccaatcacctcccaccaagtccctcctttggcacatggagattacaattcgagatgagagctggatggggacacagagccaaatcatatcaacccccacccacaccaatctcttaaatattaaaaaatggaagggtggtgcattcctgtagtcccagctacttgggaggctgaggcagaaagattacttgagcctaagaattcaaggctgcagtgagccatgatcgcaccactgcactccagcctgggcagcacagcgaaaccttatctctaaaaaaataaaaataatcacataaaacaaagcatatgtcacaagtgcctggcacatcacaatgactccctataaataatcataataattattcttgctcattataatactttgagctctgctcacagaagtacagaacaacacaggtgcccctgttaaactgaagccaaacttctaaagcagatcaattaccaggagatcattcacaatataaaggattctcatcggggactcctttaaatacagtgaaatctgtgaagggcttttcaaatcggaatcaatttaccatattgacatggaattcttcagggacccttcggggaaggactcagatgtagtgtcctctctgtcactctcatctgttggttggtgaacagcagactctgttcaccattcctacaatcagccaaggggggctgtgatgtttcacaaggcgccacggcagagagatgaaagttgttatgggtgctgttggattttagggctgctaagagaaccagatgtttaaaagtagccctgtgcaagtccaagccagagctgccaaattctcgacgcatgaaaaacaaaggcgtctggcttgggaaagtttgtcccaggcagactctctgagtctatttagaaagggttacaatgcaacgtttgtatctacacccctcctgtacaggtttgcaaaaccggaaataatgcctgtcactcatgcagtgactcctgggcacaaccttacagccagtccctgtgctgggcatcaaggaaatacagagatgacgtgaaatacctgctgggtgagccatagaagcaaagcgttatttgcttctgagtctgaaagctcagctgggtgaccttgggcatgttgcttaacctttctgtgattcagtcttctcatctgtgaaatggggatagcagcaggaccttccacacaaactcactgtgagaaatgagtaaagataaatgaaggggttggaacagctcctggcacacagtaagtgctcaataaatgtgtttattcttagttgtggtagtagactgctgataaggggctaaattcagggtgttagggtagtacataaaaaagctatctaggctgggcgcggtggctcacgcctataatcccaacactttgggaggccgaggcaggcagatcacttgaggtcaggagtttgagaccagcctggccaaacagtgaaaccctatctctactacaaatacaaaaaattagccgggcgtggtggcaggtacctgtaatcccagctactcgggaatctgaggcaggagaatggcttgaacccaggaggtgcaggttgcagtgagccaagatcaggccactgtactctggcctgggcagagtgggactccacctcagaaaaaaaagtatctaactagagtatcaggaaatgattaccatcccataccatagccagattcagctcgtggcctattttcgcaaataaaattttattggcacacagccacgttcatttgtttacatgttatctctggctgctttccggctgcagaggcacagttcagtagttgccaaggagactgaagggccctcaacatctaaaatacctcttatctgctcctttaagaaaaggctggccaacctctgatccaattcaattcaggagggatgtgatcagggaaggcttcctggagggtgacaacgtaaattttccttggttaatattgactcttgcatttcagagttattgaggaggatgcttggatcggcaggttcgggtaacagaaaggaaataagcattgccatcgacctctatctgaatcaaatcctacagcaggcatcacagaacggtggctcatgggcccagaaacagtctgcaatctaatttgatatgaacctgtggtgcttaaaaaacacccgagacaacattggatggctgggatacatcataataaaccgcctttccggcttctattaaaaactctgacgatctggcaaccctgggcccacccttcccatggagaccccttttgctggggtacctgttctccagatcaccatgagaaccttttcattcccccctttactctatgtctacagcctctgctctgatgctatcaaaggcctctcacacatattcttggttccctgccaacccaggcagacaaggcaagctgagaaaactaaagttcagagaggtcaagtgactttcctagggatagccatctggtgaatgataaagctggaccggaacctgagcctttgagtctagctcactgtccctcttcagacatacaaacagcggaatgagtcattgctacgattttactagggcactccatagtttgaatagctctttttttttttttttttttttgagacagtgtattgcccaggctggagtgcagtggtgcgatctcggctcactgcaacctctgcctcccgggttcaagcgattctcctgcctcagcctcctgagtagctgggattacaggcatgcaccaccattcccggctaatttttgtattattagtagagacggggtttcaccgtgttggtcaggctggctcaaactgctgatctcgtgaacagctctttcacatatacgagtccagattggaaaatgcagaccttggatccacggaggccacgtaaatattgagtggcatatggtcaccaaaggactgacaaggcaagaggctaaaactccagaaagataaggactagaagtgcatctagtctatctcaggagtcagagtgggcaaatctactgaatccaacaagcactgcttaagtgcctgctggaatcaagacaaagaaagaggcccagctccccatctggggcttagaatgtcacagggagggtgttacctgtaaagtaacaacgtaagaccgactgtgtttctgcaagactaaagggcagagacagctgaaacttcggtggcctacatggcagatttaaggacttactcagggcacaggtggagacgtggatttaagtgagtatgagtgatttttttcggggagtagatgatgggtgaaccatggcccttggatgatgtattcgtttcttgccagctgccataacaaagcaccactaaatggcttaaacaatcaaaatgtattgcctcccatttctggagcctagaaatctaagatcaaggtgttggtagggttggttccttttgaagcctgtgagaaagaatgttccatgcccctctcctggcttctggtggtctgctgggaatcttgaatgttccttcgcttgtagatacatcatgcccctctctgccttcgccttcacaaagtgtcctccctgtgtgcatggctatgtccaaatgtccccgcccccccccactgtttttttgttttgttttgttttgttttgtttttggcagagtcttgctctgtcacccaggctggagtgcagtggctcgatctcggctcattgcaacctctacctcccaggttcaggtgattctcctgcctcagcctcctgagtagctgggattacaggtgcatgccgccacacctggctaattaaaatgccccctttttataaggacaccagtcatattagcttagggacccccccgcttctagtatgactgcatctttgcaaattacatctgcaatgaccgtctttccaaacaaggtcaacttccaatgtactggaaatcgggacttcaacatatgaatctgggggcaggagaggggacataattcaacccataacagatgacatcctcaaagtcactgggaagcatggcaacggaggctgagatgctcaaggccatcctcgaggctcctccccacaaagggtaaagacctgggttctccctggcctttctgggcagaatgagagtccccagaggttctggtgctgttggaaggatcctaagcatcaagggaaggggtgtggacaactccaggcctccagcactgagagcaggagggaagccctgctccctcctcattacactgtggaaaacagaaaactcaatttatttaagaataaacaggctttaacctgaagttcattctcccgctccatgatgctttagcatctacatgcaaccgcagctgccagcatcatgccccggttgcacagtccgaaggacctatattggaaaaataatggcattttctcaacaaattatctcacagctgaagtaataacttgtttaaagatacgccaattcagattttcatccccttaacctgccactaaaagaaaagcggtgtcatccccatggcaaaacaggagcagtttaatcacttctgcacccctgtcctccggccctcgcccccaactccagcccccaccaccacccacagctgcacgtttattaattttaagccattgacagagtctctttggaaaccatgtttttttacttctcaggtcaacatcctccagctctgttataataaagtacacactgccagagataaagcaaatatttctttgggaaaggaaaacaaaatagagtggctgtgttttcaacacaatcgctaaggatccagccagcggacttcttctccaacagcagccatcaggctaactggccctcaccaggcttctcatttatttggcaacaaggaaatcacagcttcaaactctctcctggcaacagcagctttctcagtcttcggccaggtagacaggaaggacaggggctgacagtgaaaggaatgctgggagacacatcaagcattcaatcaacaaacagtgggtgcagctgaccctgtgcctggcactatgctagattctaggtacctcagtgactaacacaaattatagtacctactgtccccaaagaacttgcagtttaggggctgggcgccatggctcacacctgtaatcccagcactttgggaggccaaggtgggcagattatttgaggtcaggagtttgagaccagctagccaacatggtaaaaccctgtctctactaaaaatacaaaaattagctgggagtggtggcacgcgcctgtaatcccagctacttaggaggctgaggcatgagaatcacttgaacctgggaggcggaggttacagtgagctgagatcatgccatcacactccagcctgggtgacagaaagagactccatctcaaaaaaaaagaaagagagggagggagggagggaggaagggaggaaggaaggaaggaaggaaggaaggaaggaaggaaggaaggaaggaactaactaacttgcagtttaggaggagacacaggcaatgaatcaacccatcaaccttcaaagtcagcttgtaatgaaagccacgagtgaaagaaacaaggtgtggagttagagcgaggaaggccagccggaggaggggacacctgatctgaagtttgaaggacaaacgggaatcaaccctatattgggaaagtagtaaccctatactgggaagaggaaaaaaggggaagaaaaacagaagtaacagccagggggatgacataatccagctctctctcctctgtctctctgtctcactctctctttcatacacacacacacacacacacacacacacacctgtctacaatctattcttcagagtcaattctttaacattagtgtttgacaaaatgcaactctccctggaatgaattccaatcagccccagctcagtgtggatgagttttttcagagatcatggctggaaagcttgcaagggagatgatagcacatagggacactgggcccttgggctggaggatgttacaaaggaaaagggacgaggaagcaagggaaacggacttcagatcaatttccaaaacttccaccattctgccttgaggttgctgggaatggagccacccggggtgggagagtcttccagaaaagccagacggacttcctgcaagttcaatctctgcctaaatttatacagagagatatacttatgggcacatatttagcatttgcaagctgaagttgtggaaatggcacaagaactggccagggcaactttgagcttaccgatgtaactatgtgtagtgttctgcaactgagttttttgaggaaagggatggcttcttcaacatccttttctatgttcccgggcaggtaatttaacctctctttgtctctgttcctatatctgtaaaatgggaataacatcatccccacctcaaggagctgggaggggtaaattttaaaatgtatgctaagcactcagataatgcctggcctagttgttcaatgaagggttagtggctatggttattattattattattattattattatatcaacttccacaacatttaggagcactaaacatttatggaatgtttcttggccagtcagctcctgcttaaaaaattattacagaaataattagaaaataaaataaaagccataggcccaaagatatttacaacattatttatttagaatatcaacaaaaatctaaatgttcaacaattgagcaatggtgacattaaataaggtgcatcaacgcagtggtgaattatgcgctaattagcaggatcagcagagagatgacagaaaagctttaaaagtgtttctaggctgagcgtggtggctcacgcctgtaatcccaacacttcgggaggctgaggcaggtgaatagcttgagcccaggagttggagaccagcctggacaacatagcaaagccctgtttctacaaaaaaaaaaaacacacacacacacacacaaaaagttagccaggcatggtggtgcacacctgtagtcccagccaaccaggagactgaggcacaagggtcccttgagccggtgaggtcaaggctgcagtgagccgtcattgccccactgtactccagcctgggcaacggagaccttgtctcaaaaacaaaaacaaaaaaaaaagggtttacaaagcactattaagtgaatatgaaaaagacgaagtgtacacagtttaaaacaatgggtataaatacagaaagaaactgaagatgtgaaaattgcagttgggttggaatggtgggttatggataatgttttttaaaagatagtttacaacatgagaaaatacaaaataaactgcttgtggaaaaaataggattcaaacctatgaggggtttatttgggggctgttggagcatacagttcctcctttaagacatggacaaaaagaagctctctctcttgtctccatggcaaacacctaaatggaaggtgaaaatgcccatcattaagctctcttgatattgagcttgtcttattctacatacatgggtgtttgttttactatatccttttttttcttttctttttttttttttttaagagatagggtcttactctatcacccaggctggagtgcagtggcatgatcacagctcactgaaacctcaacctcctgggctcaagcaatcctgcttcagcttcctggaaagctggaactacaggcaacttccaccacacttggctattttaaaaattttttgtagagacagggtctcactctgttgcccaggatggatataccctattttctgatgaattaatagataaatgaatcacaaaatattcaccaggtgcttatgacatcaaaggcctgtgcggaatgaccatcatcccagcttccagagtgaggacctcaaatatgaagacgatacacagagacaaacaagtaactgatggtaataagccagccacagctaacacttaccaatgcttcctgcaggccagggatcactctatggattttatgggaatacctccctttaatcctcatatccagccttggatgcagctatagccatttgacagatgaggagacacactcacaaagggcaggcgtcttgcccaagtcatacaaccagtaagcggcaaaacctggctttgaacctacaaatcttctgccagggccggcgattttaacacctggattagtctgttttcacgctgctgataaagacataccagagactgggtaatttatcaagaaaaaaaggtttaatggactcacagttccaggtggctggcgaggcctcacaatcacggcagaaggtgaaagtcacgtcttacatggcaacaaacaagagagaatgagagagcttgtgtagggaaactcccctttataaaactatcagatctcatgagagtcactcactatcacaaaaacagcaccagaaagacctgcccccatgattcaataacctcccaccgggtccctcccacaacacgtgggggaatcatggcagctacaattcaagaagagacttgggtgtgaacatagccaaactgtatcactactctactgcagaagaagagccatgaaagctgttcacagcaggagaggcaaaaggccctttcctcaaagcccatctgggaatacctcacccttgtctcttctccagacacaattctccattgagagccgtcctccaagacctcaggttcataagggctagaagagcagcttgaaacgctggacttgccctttggagccagaggtcaggccaggtgggagccatccactagcaggttagagacaacgagattctctctgtgcagttcagaccacagccacagagaattatttaaacccctcctgggaaaccgcagcaacgtcagacagattcaatgtgcataactgtatgtgtgtgtgtctatgtgtggttggggggggggctcagggaggaggtgtgacaagcctgagtgacccaggagggactcagggcccaggaagggtcggatactcctcccccatccaggtgggacacagcgagctgagcagcccctgatgaaaccaaaagagtctcagatcctgtcccttttcctcctcagaactcagagcactggatcctttgttcagaaagcaagagaaaacaccaacacaattcctgctacagctgaggatgagggcgtggagcaggtcacacagacatactagcaagcctgcaaagtcaaaaccgtaacagccacagtaactgacacacgtcaacaactgacctggagccagatgttgccccatttaacctccaagactctcctgtgaggtgagaaccatgatcatccccattatacaggtgagaaaaccaaggctgatgggaattcatcacatggtgcataggaagcaaagccatgtttcgaatccaggaagcctctctgtcttaggaagacacgcacccactcatgcatgcaacaacagatgcacaagtaacagtcagagttggccaggcacaggggcagttgcctgtaattccaacaactcgggaggctgaggcgggaggacgacttgaggtcagcagttcaagaccagtttgggcatatattgagaccctgtctctaaaaaataaaaatttaaaaagaaaaacattcagagttgtgtacattcacaaaaggcatgcaaacatagcatagggatagaaatacaggcataaacgtgtgcagagagctgcaaccacgcgcatctgcccctcttctccaaataagggctgcctctttgcacacctctgagaggtgccctccacacagaatacaacatacacttgtaatattgccacacacaagcacataactttctggagggatgactcagattagaaaaacagcatttagagggcccctggttaatcaaacggcctcgccaccccgcgccacctctctacacagctgatgttgctgatcaatgtcgcggctgtgcagagggggcatttgataccacaaagggagccaactcctgctgaggaatgaatgtggcgcttgtcagctctgccccaggcagcagcacaacatgatgccctgtttctcctggaatcggggccctgcgtccgctccagccctcattttcatgtctttcttcccaacagacacaaggccggctcagttctggagaaacagcgtggctgccaaggcccagtggagggagaaggccttgaaaagtcactttataaagcatccgtgctcgcagcagccaagccacgaggccggagcggctgactttccattcgccacacaccccacccaaagacgagaactctgccacagccagcccttgttctcacccactgggagccctggggagttgaaatcacagggacagcagcagggagcccttggcagcaaacccagctcctggcatcttcctcgggggccgtagcttgctgtggtcagccgagccagtctgatgcaagaactgaatgacgcccattcactgtggtgccctcgtgagctgggagatgtccaggctgaggctggggcaggcaggctctctgtcacctgcagaggctgagacaacctcaaggtaggacgagaacccagggttgaagctagcagaagccaggccctggggcccctgatgcatgatgagagtgaaaagaagggcacagtgatgtaaagaattcctccatttcccctccctgccctcagttacttcctatccatacagaggggggatgaaaactttaagatttcactattcagctgagactggtgactcacgcctgaaatcccagcactttgggaggctgaggtgggtggatcacttgaggtcgggagtttgagaccagcctggccaacatggagaaaccccacttctactaaaaatacaaaaattagccaggcgtggtggtgcatgcctgtaatcccagctatttggaaggctgaggcaggagaatcgcttgaacctgggaggtggaggctgcaatgggctgagattgcaccactgcagcctagcctgggcaacagagtgagactctattttataaaaataagagactccactattcatgcattcacatgctcattcaacaaatattactgagcacctactatatgatgagtgttattgttttaggcactgggagtacattagtcaaataaatagtcaccacctgcatgtagcttgttctcaaaattctcaagctctcccaaccctccccataatgaacagctgtgtgacttagagcacactgcttcccctctctgtgctccagtgaggtctctcccagggttcctgtgaatcaccatctgggatccagtaagctcccccatggggcctaaactagactaagttggtttccgtcactcacagccagaggagtcctgcctaagaaattgggaaagagagcggagaagacaaaaagcaggtttgggaaggctgcagggagctgatgagtcatttgatcatctggaaagcagatgggaagacaagtggagaccaggaggccctggggaagagaagctgtgttcacgccaaccttccccagcaggcctcagaagctgggggtcaaaagggaccacaacgcccatttaaacaaggaggaagatgctgaacagctaaagggttaattcaaaagaaaaaacaaaagaagaaatggccatttcttttccttgttcactcaatgttccttcaacaaattattctatgtgcttggaatatatgaggccctgggttgggtgtggtatgcaacagaaaaataaaacataagaacatagtatgtctcttcccacagggtcatatggtctttcgaaagtcacccttttaatttgaaaccttttgctgcttctttatttttattttttaatttaatttttttgagacagagtcttgctctgtcacccaggctggaatgcagtgacgcaatctcggctcactgcaacctctgcctccggagttcaagcgattctcctgcctcagcctcccaagtagctgggattatagacccctgccaccaccccagctagtttttatatttttaggagagatggggtttcgccatgttggccagcagtcttgaactcctggcctcaggtgatctgcctgcctcggcctcccaaagtgctaggattacaggcaggagccactgcgtccagcctatttattcttattttaaaaatttatatatatgtgtatatatataaggggtataacacagcgttatttttaaggaataagagatattttgcttttcaaagtgcctgctaagcccagtgacatacgcttggttagcaatcactaaatgtggacacattataaatcctctatatattttatagagatggggtcttgctatgttgcccagtatggacatgcgttcctgggctcaactgatcctcctgctcagcctcccatgtgctgggattataggcatgagacagcagcactcagtctctttgtttatttctctgcctgctccccacccatctgtgtgacccctactaaaataaccactgcatggtgttcaaggaagagtatggccttgggattcaggcaggtctgcattctaacccagggccttctaccttctggctatgtgcccctgagcaagtaacttggcctctgctatggcttagatgtgtgtcccctccaaaccgcatgttgaaatttgatccccagtgttggaggtggggtctaatgggaggtgtttgggttttgagggtggatccctcatgaatagatcaataccctccttctattagttctgcaagagctggatgtttacaaacagtctggccttcccctccctctctcttgctttcttgcttacctgtaatatctgcacatgccaactccccttcaccttccactgtgagtgaagctgtcggaggccctcgccagatgcagatgcctaatcttgaacttaccagccatcagaatcacaaaccaaataaactttctttctttataaactacccagcatcagatattcctttatagtaatacaaaatatacgatgatagcctctcagagcctcaatcacctgccctggaaaatgggtacaacaccgagttctttttaaggaataaatgatgttttgcttttcaaagtgcatgctaagtaagtgcagtgacatacgcttggtaagcaatcattgagtgtgaacatattataaattctcatgaaatctaagaggcaaagccctgggaatatcacaatattgatcttctaaagtcagtatcagctttctcatggctcagactcactcctgagttttgtgcttggatacttaacaattgctcactcctaaatttcctaactagttccagcttcaaactggaaaaattcctccagtgtattcaagcctcgttgcctagcaccacaatatccttggttgatgtgcttctaggtgctaaaagaataggccggggatggtggcttaggccgataatcccagcacttttggaggccagggccggcggatcacctgaagtcaggagtttgagaccagcctgaccaacatggagaaaccccatctgtaataaaaatacaaaaattagctgggcgtgctggcacaggcctataatcccaactactcaggaggctgaggcaggagaatcgcttgaacccagaaggctgaggttgcggtgacccaagagatcgcaccattacactccagcccgggcaacaagagtgaaactccatctcaaaaaacaaaacaaaacaaaaaaaaagagtaacgagtgttagatattggtgggggtggcatcagaaggactttgtgtgacattcccaggtctgttctgagcgcaaaggccagatttagacagcgttgagaacccaaatgaggctctagaaactggtccaaacaatgtgcccataatgacacgtgtcaaaaccgaagaaggccttagtcaggggaaaaaagatgcaaattacaaagacctttttcagagccaccaccttctaaaagtgaacagaaggagcaggaagctgccaaagtgtaccagaacctcctccttcgacgctagaaagagtaacaggtcaagctccaacttgcaattcagttctattttgaagtttactggaaagcagaaaataagaagggatttgagagaggccggcagtttgaaggcaaggaggaactgaaataaacacattagacccaagaacacaaaagtcctagcagcttggacctgctatttctcgacagttcctccaggctcctcatgcataagccaatcagcaatgatgtgcatatttcagcaatgatgtgcataatattgatcttgaaccacagcgatcttcctagttccttttgccaggagaaaagatgggggtggccacacatttgagaaagaaagtccattaacattacccaagttggttttgaagtattgagacacttttttttttttttttttttttagatggagtctcactctgttgccaaggctggagtgcagtgacgtgatctcggctcactgcaacctctgcctatcgggttcatgtggttctcctgcttcaacctcccgagtagctgggagtacaggtgcccgccaccacgtccgactaatttttgtatgtttagtagagatggggtttcaccatgttggccatgctggtctcgaactcctgacctcaagtgatccacctgccttgccctcccaaagtgctgggattacaggtgtcagccaccacacccagctgagacacatttttagggtgtgtgtatgaccgagttttatggttgcaaacaaaagactccatgctgcccagttcaggcataaaaagaatgtcctgaataatgcaagatgatgtataggatgcttggacaaccaaagccaaatgtggaggctctgctgtgggtgatcatgtcccaaccacacggacactgaccagcacagaccctgtccctgctgctaatgagttcacactgccaccaccaggcacagacccaaatccttgaccgctgctggctgccccttttgccagaatggattctgtaccaggctagtttccccacataacttgctctttcaggaaatccaaaagtattgatacaaaaggtgtattagagccataagtgcatagagagaaaagcgggtacattaagctttgattctccactgcctgttgtaatagtttgttttcacgttgctgataaagacacatccgagactgggcaatttacaaaaagaggtttattggtctcacagttccatgtggctggagaggcctcacaaccatggcagaagatgaaaagcacatctcacatggcagcagacaagggaagagagagcttgtgcgggaaatttcccttttcaaaaccatcagatctcatgagactcattcactatcacgagaacagcgcaggaaagactcacccccatgattaaatcacctcccactgggttcctcccacgacatatgggaattgtgggagttacaattcaagatgagatctgggtggggacacagccaaaccatatcacctgtcattacttttttttttttttttttttgagatggaatctcactctgcggcccaagctggagtggtgtgatcttggctcactgcaacctctgcctcctaggttcaagcgattatcctgcctcagcctcctgaatagtttggatggcaggcgtatatcagcatgcccggctaattttgtatttttagtagagacagggtttcaccacgttggccaggctggtctcaaactcttgacctcaagccatctgtccacctcagcctcccaaagtgctgggattacaggcgtgagccaccatgcccagcagcctgccattactttcattagcaccaggcttcttgcatattttacagattgctgtcaatggtctaataaacaggtgtgttaacacatccagcagtaaagaaccggggccctcgaacctgcctgcctgggtctgaaccctgctccccagcccttacttgctggaagaccttgggcaaattattcaactcccatctgagaatattattcataacagcacccacctcatgggccagttgtgaaacttacagaagtcaatttaaaccaaggactgaacatagtacttgtaatatgagtttgtacaaaagtatcagttgctattgttgatgttgataataaaagctaaaataacattataacccccttcatggtggtagtttcttcataagctgccattaaagcaaagagctacctacttaatacaatttgctccctaattaattaattatatctaaatttcattgtattgtgtcattctacaaggaatgctgctactatcaccttgggctgctaaaaaaatgcccagtcactaaaaaaaattgcttagacggtattctctgtcatttctcccaacgaataggcagtttattattttttgaagaagtcttttggctgtgacaatggggcctcataacaatgaattgagaacaatcacttccaaacagcagctgaaaacaccccttggttgcctctgagtttgggggtcactgatcaagagggtgacttttctgggacctctgatctcttaatagttgtagttcaacaagagcagttgtggtacattcggcttcaccttcatcgtgggagaatgaccagatgcctacctggttttaaaccacagtcaggggctccggaaactgtccaagaagaaactccggtgccctgaaggcctctgatgagcaacagagttaccttactgactgatggacacagttaattcagctgctaactctcaaattctactgctgactcacaatccggctgcccatcactaggtggcccggaggcctaaggtgaaaaggatgttgtctttctctgggcacattttcagaaagcccatttaaacttcttggtggggcaagagggggcataaaagggggaacaagatcttccacattgcaatattcatgttttaattagcgagtgtccagaacctcatatcaacttgatttgaagggcatgtgtaagaagtatacctacaactccttctctgagccccaaaatggcccccaaaaacgctccgcacagctcctggggttgaagatcctggtgaggtgcagtttgttctcacagccaccgtgcagcccaggtccatgtgcatgattcacacgagaaactaggtgaatagcactcctgggggtgcagaggtatacagggcagaacctggcacacagcaccaggtccacgtgagggggtcctggcgcacacacacgtacacaaacacacacaaaccccacacacataccaaggattccagaattctgggcttaactcagcctagactctaccacattcttcattctgtagttagaggccaaaataaaactcgtgtaaacagattaaataccgtggtaaccaaattcaaaccaaacaccaaggattgggtggggggaggggaaatagtcttactttgaagcatttgggggtgtgggggtggggaagaaaagaggtaaagaggctctaaagattctaagacatcaaagttcttttcctgatttcccagtggaaacaggacagtttcttatactaggtctcccagtggatcaccatccaccatcttggaaggcagcccaactgactgagtcccaaggagacctaacagagatttactttcccaaacaaggaatacttcaataagggtgtatctacagttagagtgcttaattcctttccgagatgttttcctaatggcagcactcctggggagagtcagaagaatgtgtaactggtcaaatcctgaacctgatttgcagtccagcccatgttcacaatgctcgtatctgctgagcctctgacttctgcgaccaatataggccaagtgtgtctggagagataatacatatagccacactccccaccttttcctcaagactagtccagaccacaagctggatgaggtcaaaaactatgtctaatttctcaccattgtatgctcagtgcccaggctggtgcctgacacgcagtaggcagtcagtgaatacagcccaaagagaggtatggccacagtcatcctatttgtgcccccgggacctggtactcaaaaaagaagtaacatatctgatgatggtatacaggcatgcatcaatgccacacactgtgcactgaggggacactgggctggcttcacacccttcaaggactctaagcagtcatgctgggtacccacacatgagcaaggaagggggtgttctgtgtgttttcatagataatgcatttgtctatttgccatccattcatcacatggctaattagttcaactacactttcttattttttgtcatcatttttttttttttttgagacagggtctcactctgtcacccaggctagaatgcagtggtgcgtggtgcaatctcagctcactgcagcctcaacctcttgggttcaatcaacctcagtgttcggagtacctgggactacaggtgctcaccaccatgcctggctaatttttgtattttttgtagagatggggtttcgccatgttgctcaggccggtcttgaactcctgggcttaagccatccacctgccttagcctcccaaagtgctgagatgacagattttctgtattgtagatgctctagcattaggggttttatagacctgggtaaagacatcccctcccagttctagcccgttcttagagatagcaaagggctcaaccaggagcaagcctctcacatgcaaaccaacaaacccagagtctataccccctcagccatcaccatatctaactctcacacaccaagccaattttcccccgccctaaaccaacctggggccaggtagcaggcagctagagacccctctagagcccaaagccctcctgaaattattcaagccggtcaatcccaaactgtttgccctgccttgcctcacctttcctgtgggaaccccagtaaaggttctggcctagattttctccttactcctgtcttctgcctccaaaccaaaaaaccagggcctcctgctgtggccctgcaagcatgctgtgcctcttctttctagggaaactgagtcacactaaactttcaagggcattgacctcactgtgatgtcacccagacatctctatttatttatttggtgggctttatttctatttatttgacctcgctgtgttgtcacccagacacctttatttacttattcatttatttggtgggcttcatttatttgtatttattttttagagacagggtcttgctctatcacccaggccagagtacagtggcacaatcatagctcactacagtctcgacctcctgggctcaagcaatcctccagctttagcctctggagtggctgggaccacaggtgcacaccactatgcctggctatcagacatctttataaattaagacccaggcacaaaacgagacggacccgtggatgagtctccttgtaagcgccttgctttctccgcttcctcccacactccactgggcacccacaggaagccctgacacacataatgagaaatgagcaaaagggcatttctgcaaagggagatgaaaaacaaatcttagaggagtggcgagtgtcctggttaaggctatggagccaggcagcctgggtttgcttgaaggtcacccctgccaccacctcctcactgtgtgtaccagcgcagcccctcaccaccctcaactgccgtttgctcagttatggaacggggaccaggacaacacaagatgctgtgagattaaagcgcatgaatacccaacggggccggcatgtggtgagcactgtgtggacggtaactgcgatgattcctcactctgccttctccaagggaatcagaactgcagaccccccgcagagaaaaacgatcacaccctttattcagcacttcccgcgtgtctgacacacagcacccacagcctggggtataaacaccaaaaaccaccctcacaggggcggaatgatgttcattcccattttgcagaagggaaaactgaggttcagagaggttaagcaggtttcccccaaaacacaaagctggaattggtgcgtgcagccaggatttctgactccaaaaactctcctctcctctccctactttcaatctcccccatttctgatcccctcccctccactgcaacacatatatattgagtgcctactgtatgcgaagagctggtgcaggagttgagaacacagcagtgagcaacactgctggaatccgagtctttatgaatcctacaggcagcaggaaagaggtcattgaggggtaatctcagaaataaatggaggccgggcgcggtggctcacgcctgtaatcccaccactttgggaggccgaggcgggcggattgcctaagctcaggagttcaagaccaccctgggcaacatggtgaaaccccatctccactaaaaaatacaaaaaattagctgggtgtggtggcacgtgactgtagtcccagctactcaggaggctgtggcaggagaaccgcttgagtccgggaggcagaggttgcagtgagctgagatagcaccattgcactccagcttgggctacagagtgagactctgtctcaaaaaaaggaaaaaaaaacccacagaaataaatggagagttcagatggggatgagagctatggaggaaaaggagaagctgctgtggtgagcaggaatacgagattccatttgctgtgcatgcagtgtgtcagacacacgggaagtgttgaataaagggtgtaatcatggaatcaaatggatccctgatcatggatcaagaatcacagacagcttctatggggaagaacattctggaaggaacagcaagcatgaaggtccccaaatgggacaggactggatatgtttgaggaactaccagaaagtcagtatggcagtgacacagtgacaagagaaaagcaggcaatgagaggagagcagaggtcctaccaagctcggccctcccgacaatttgggttggatcactgtttgctgtggcgctgtcctgcactctgtagaataagatgtttagtggcacccctggtctgtacccactaaatgcctatacagctcccgccctgtcctgccaaccaaaaatgtctccagacattgccagataatgcaccccacatcccttccgggataaactgtgagactccacggcgatgctatttcagggacaaaaagaagcctgtgcttatggaacagaaactggccttgccacgacctcattagtggagaggatgggccccactcatttgggggaattatttggggaaaagtataaactccctagctcagcagactgcgagctccccatgaaaggccatgtgtcctggttcctcacacggggcctgagatgcgaaagcacagagggtacctgggagggactgagaaaggaggggactgtggggtccagtgggcacatccctatcacaatcagcctgtgcagctaggaggctgccacgcacatcggcagactctggctttcaaaatgaccctggaggagctgcggctcctgctggcatgtcaatgtcaacagcctttaccctccccagctcctggaatgctagaatttagattctcagttctgcgggagagcaggacagatttacggaattctcagcggctgcctccaccaggggttgccaggggcaagcatctgcaccgtggtgaaacatctctttgaacaaggaagtgagagtgagcatgtgcattaactatcggagatgtgggggagaggaggaagccatgcaaatgagcacggacagccagcagagacgtttaaccttggtgctgctagagtacccacaagtgctaacgaggtggctggtgttgctttaataatcaaataataaccaggcaatggtttagatccattttggacccttcacaattcccaggactacacttaacagtttggtaagactttatggatagcttgcaagtttgaaggcgtaactttgtaagctcagttttgaccctggaggaaggaggtcatgagtaagatagggacaccaaaaagaagtcaggtggtatgctttttccattgactcacagtcatttccaggagaaaagaaaacatcactgtgcaaggctctactgactctcttaatttatcctcacaacagcctcgtatagtaaatattatcctattttacatgggagaaaaatgaagtttagaagcttgggaaatctggtcttcattatttggctactaacccttagtttccatcacaattccctcattctctcagctctagtctagtctggatccttttgcagtcctgccccaggaccttggcacaggttgtttcctgtgcctggattactctgacctcccttcttcacctggttaacgcgacttaaccttcccattcctgcttgctcatctcccagagcctcctctgggctttttccaggccaaactactctaacaaaagctctcttagcatcaagactgctgcttctgcatcaggactcttcaaagttacaatttaacaaagaagccggcgtgtgctagttcaccaccgtaggcatatgcgtcagattcaagatggcttcaaattctttgacatgcctttatcgaaaggtagtgtcttattcccctcctcttgaagccaagatggccttactgactcagctgaccaattgaatgcagtgaaagtgatgttctgggaattctaagcctcaatgataacatacatacctttgcagctcctgctggacctcttagaatatttactctggggaaactccctcttggaacccagccaccatgtggcaagaagcccaagacacacaggatagaccatgtctgatgcagccaacagctccagctgagctccccccaacaaccctcaccaactgccaggcacgtgcatgagacaccttgagcaaccaccacagccaaaccttcagatgatcacagcccactccatatgtgtcagtaacatatgcagaaatccaagaaagaaccatccagccacgtctagtcagcccacaaaaccttgagagatgatactaaagcactgttttagtcattacgttagagaactatttgttacacagcagtagatgatcagaaccctgtaagatccagcataatgaacagttgttcagcttgtacacaccttaggcagcagctaggactagatgcttaataaatatattatttatggattagacaaagaatgtagtgtgtgaaaagattaaggtggaggctggatttatacccgtttatataactccaagttcctcctctcttttctttttaaccatagcctaatgctcccttaaaaacaataaaaccattttatttccagcctatcatatttgatgcaggtttgggaggaagaatacaatattcagacagagccatgtcacaacaaaatggcagctttggttgcttgtcatgcctggaaaaaagttcagagttaaaaaaaaaagtagcttgaggctgggtgtggtagcttacacctataatcctagcacttttggaggctaaggtgggtagactgcttgagcctaggagtttgagaccagcctgggcaatatggcaaaaccctgtctctacaaaaaatacaaaaataagccatccatggtggtgaatgcctgtagtcccagctagttgggagtctgaggtgggaggctcgcttgagacctggacattgaggctgcagagagccatgatggtaccactgcactccagcctgggtgacagagcaagatcctgtctcaaaaaataaataaataaataaaaaggctgttcttatgtcattacactcattgacagcacaggggtctctatgccctctctgcagttatagcatgagcgctgctgtaggcgatatctaaatgaatgggtatagctgtgttccaataaagctttatttacaaaaacaggcagtgggccagattcgcccaaccctagtacacagcataatacagtggtctttcaatttagcagtaagcacgcagtatagggaaaagttaatccacggacctctttttccttctgtaaattgaaagagagggagcctgcttcctttgatttgagtatggaatgaccttggctagttcgtgaagccatccatggtggtgaatgcctgtagtcccagctagtcgggagtctgaggtggaaggctcgcttgagacctggaggttgaggctgcagagagccaggatggtaccactgcgctccagcctgggcgacagagcaagatcctgtctcaaaaacaaaaacaaaaaaagatagactgctcttatgtcattacactcattgacatagctcaggggtctctatgccctctatgcagttatagcatgagctatagacaataggtaaatgaatgggcatagctgtgttccaataaagctttatttacaaaaacaggcagtgggccagattcgcccatccctggtacacagcataatacagtggcctttcaatttagcagtagccacgcagtttgtaaactcaatgaaacaggcaatgcctttgactgaaatgactcttggtactttaattttgcattttagacaacatctttcactgcattttcacatgctgaaatgggttcagatttctaaaatataagaaaaagttacagtaaaacaaaacaaaacaaaaaacacttaatatagggaaaagctaatccatggacctctttttccttctgtaaattgaaagagagggagcctgcttcctttgatttgagtatggaatgaccttggctagttcatgaaggcaggaacattccatgagacaggagttaggaaaccactgggtcactcatagcaaggataatttcccctcactggccctcaaagaactatttgttgataaataatgaatccaaaatctattggaaggagagtaatccactcattactgttagtccattcaatagggctcaatgactgggtgaagtttattcaaagcagcaaaatatcatctaatggcttgctcttttgtctttgtaggatcaagcctttcatcttagaaagtgctacccacgttatccaaaactagcaaaaataatttaattaatgtgtatataagccacaagtgcccaaattatagcttgtgcccaaaccctaggtaatgctagagttatacacataattttttaatttcgtattttcaagaaatgatagaccctataaattatatttttaaatgagccaggaagtaatggctaatgttaattcttaggcaacagaaacgtgctacgctaattattattagcaataatggctcaatgggtaaagaacttctgaactcacaaagcaatttttaaaaactgtattgcattgtttcatacctaaaagagtcccagggttaggtaatttttttcattttataggtgaataaagggagacgcagggtaggtacctgctcatagtcatagctaagtagccaggactcggttgctatccaaggcttcttctatctggaacacttcaagagaacaaggcaactcctctccaaatataattaatatgcaacctctcttcctattattctttgtgaagtttagcactatccaaaaaaatgtactaggctaattattcagatttttttttgcgaagggtgcaaatgttctttctattgaatgtgtgtgcatgtcatttattacaccatatttttaaagggagactaatgcccaataatgaccccagggcttagctttgaagaaaattccaaccaaaaacatcaccttactgtctgaatctgtctccatttcagcaactgaatctttgttgctggactcaataaaacacacttcagatttctaatgcttggatgggagatgagttggtccaagctagatcctcttgtctttgggcccacaccaaacaccaaacacgagtcaaccactcttgcaccaccacaggtatgcatgtattaatatcggcttcccttctgccacagctgtgacttgtgttgggattatttctactccgccagcttgtttaccttattagagtaaccttacagctcaatcattaggactccatggagaagccatggaaaatcaagactcagacatatatttcgatcttaggagaacatgcctgtgctttgtctgtcattattctttttatgggattctaaggcagtctaagataggagaatcactacaaggctcctgaaaaatccctgccaattaaggagtgacagactgcattttccaaagatgaccacagctatatttcctatcccatatgctcttctgcaaggtgactttgccacccccatcccttcaagaggtgggacttatttttcccgtccttagaatctggacaggccctgtgactgctttgagcaacagaatatggcaggagtgatgctgtgccagttttaagtgtagcccttaactttatggcagcttccaccttcctgcctgctggaggccagccaccacatcagaagtgacactaccctgaggccatccagctgtgagacaatcaagccacaggaagatgcttgatgctacctggagagaaacagacagaggggtcaaggaggaacaaagcaccagacagacggacgataaagtcttagaagtggatcctccagccccagtggacaacacatggagccgagacaaacctcccagcagagcccttcctaaggtcctgatccacaaaattaggaacaaaacaaaattaatgttttaagccactcagttttcagatagtttattatggaataccagagaactgttaacatttttttttcaagaccgagtctcactcaatcacccaggccagaatgcagtggtgcaatcttggctcactgcagccttgaactcctgggctgaagcaatgttcccacctaagccttccaagtagttaggtctacgtgtctggctagctttttttttgagacggagtcttgctttgtcacccaggctggagtgcaatggcatgatctccactcaccggaagctctgcctcccgggttcacgccattctcctgcctcagcctcccgagtagctgggactacagatgcccaccaccacacccggctaattttttgtatttttagtagagacggggtttcaccatgatgtctggctaactttttaatctttgtagaggtggggtctcgctctgtcacccaggctggaatgcagtaacatgatcatagatcactacagcctcaacctcctgggatcaagtcatcctcccaccttagcctcctgagtggctgcgactacaggtgtgtgccactatgcccagctaattttttaaaatttttcatagagatgaggttttactatgttgcccaagctggtctcaaacccctggactcaagtgatcctcccactttggtctctcaaagtgctaggattacaggtatgcaccactgtgcctggcccacaaattttactttattatttttttttggagacagagtcttactctgtcacccaggctggagtgcagtagtgcgatcttggctcactgcagcctccgcctcctgggttcaagcgattctcctgtcagcctcccaagtagctggcattaaaggcatgcaacaccacgcctaactaatttttgtatttttagtagagacggggtttcaccatgttggcaaggctggtctagaactcctgacctcctgacttcaggtgatccgcccacctcagcctcccaaagtactgggattacaggtgtgagtcaccatgcctggcctcacagatattttttattgaaacacaagttagatcttccttggggtcactgcaaatagttgtatgatttgtgtaccgcaaagtggcaaataggggctgaaatccaaccagtgctttgctcaccacgccctgcatcggtgagctctggtcttctgctaagaggctgacttttttagccctgcaaagtccccgtacagactagcagtacgtcgaagcacagtcatccaaatgtgggaccttcaataacgatgacttaagaatttgacggaacaatgtgattatcgttgccagaggaggtttttcttccctgctaatatcctggacacctcgctgggcttgccaactttatctggtcccttcttcctctgccccaagattccacccttaaactggagtaggtgctttcactgcccagtggggccgcccttctcggcaggcctccccagcagcgcctgatgtttcatctcatgtgaaattgccccaaaacacaggatcagctctgcactgggccatcactgccactcctcaggggcagctgagtctcctccctgtggccttccaacaatggctggcagtaaggctcattcagaacccattaaggcgattgttttttcctcaagggcacttccttgagggctgaataccaatcagcctgcgatacaaaggaggggccccctgtcatccttgggactgtgcagtggctctgtggggacaatcccacgtgctgtcctccctacaacctcactcccctgggcttttgtgcaggagtcaatattgattactgttatttctttcttttttctcttttttttttgagacagagtctcactctgtcaccaggctggagtgcattggtgcaatctcagtcttagctcactgcaacctctgcctcccaggttcaagcgattctcctgcttcagtctcctgagtggctgggactacaggtgcatgccaccatgcccagctaatttttgtatttttagtagagacggggttttaccatgttggccaggatggtctcgatcccttgacctggtgatctccctgcctcggcctcccaaaggattactgttatttcatgagatgactacaggctcatcatgccacagcagtggtgacccaggagcaattctcatagtataagcaagtcctatagcaaaatccatgggaacctataggaccgtggccaaagtcatctctgcctcccaagaaggggcaggaagtcctattggcctcatctaaccatttatgcctgttcttacaagctctcaatctgtccatccaacccaggagacactcggtcatcatccaccctttacttcttctgaaaagctgatgcaaataacttgggctttaaaacccaaaaagatctgtgtcccaatccagactctgccacttcttagctgtgtgatgttaagtgactgtctaaacttctctacttcctcacctgtcaaatgaaagcaaggacaccttctagcaaacctgagagaactgaacaagataaggccaagtaggctacaaatggcacccacaagttattccattcggttcatgaacaaacctttcattacaaattccaatacttatgtatttatgctgatgtatgagaagacgataggcttcatgaagaccatgattttatggacattatagcttaggttgagctaagtaaaaagtgagtggatgcaaagaaaaatatgaagtaaataaaccatgaccggggagtgttatgtggatgctgtagaaacaccaagaaaataagataggtggacacagccgggtgcggtggctcatgccgtgatcccagcactttgggaggccgaggcaggcggatcacgaggtcaggagttacagaccatcctggtcaacacggtgaaaccccgtctttactaaaaatacaaaaagtagctggctgtagtggtaggtgcctgtaatcccagctactcgggaggctgaggcaggagaattgcttgaacccgggaggcagaggttgcagtcagctgagattgcaccacggcactccagcctgggtgacagagcaagactccatctcaaaaaaaaaaaaaaaaaaaaaagatacgtggacacacaccccgacactgtaccacatggtaggtacagacatcaccaccacctggcacattttaggtgctgaatcagcatctgtttccctctcctgtaacctcctgtggcatcagcctccacccttgaacttggctccagcctcattagggtttggccaagccttagaagttggaggtggactccctgcagtcttggggacggttcccaacaccagggtggtaaggaggaatggtctttagctttgcaggtcatgatttcccttgaagcacctcgtaaacagcagggctggcccacctcaataaaattttactcagcgcttgcaattcccccaacttccttccgtagccagatgctgccctttgctgtgtgcttaactccccactgacaactgatggcatttagatgcattgtagggtgagacccagaaggctgctcattaacatcgtctatatattttaagagccaagaaaccatttttcttggacctaccaattatataggacaccatgcagctcccttccaaatgtcgacccactctagatagttgaggctaaatcaaccaagaaggtgtattagctttcaccagacccatggacaaataattcttcttacacttctaggtagcaatgtaacattttgcttcccagaaaccaaagctcacatttaaacacatggcacccaagcccatatttcaggaaaggccctttgttaattgttcataggaaagtaatccaatagggtctccaacttcctgctgctgttcattccacctgctgctacacctgggcttatttattccaccctgaatggttttctttcccccagcacacagccaggctggttcctgcctccgtgccttgcccaggctgttccctgagtcctgaatgcccttcctgctccttcctgcctaccaaataccttaaatacatccttcaaactcagctcagatggcgctccctccaagaagccacctgtaacttccagaaagttaatgtcccgccaccctgtgccacttcctacctcgtttagcacgtcatgtggtaccatgaccacttccatgtctatacgtgtattttgccacgagatctgttcccaatgttttgtaaggaacaaagtaagtgagcaatgcatgtctggagaatgaataaattcaggaatcccattaatgacagtatctatctgtttaacaaatattcatggagcacatactaagtgctagggactgaggataccacattaaagaagaagaaaggacagattcctgtcctcatggggtttatgttctagatacggggagaaaaagttacatacaaataaacaagattattttagatagtgataaatttatgacaacaataaaacaaggcaatagcattacggccgggcacggtggctcatacctgtaatcccaccactttgggaggccgaggcagatggatcacctgaggtcaggagttcaagaccagcctggccaacatggtgacaccctgactctactaaaaatacaaaaagtagccaggcgtggtggtccagctactcaggaggctgaggcatgagaactgcttgaacccgggaggcagaggttgcagtgagctgagatctcaccactgcactctagcctgggaaaaagtgtgagtgagactccatctcaaaaaataaataaataaacaaaacaaggcaatagcatagagcagagattagcaaactttgaccagtgagtcagatccagtctaccacctgtttctgtaaataaagttttattgacacatagacacgcccactaagttattgcctctgactgcttttgcccaacaatggcagagctgagtaggtttaacagagaccctatggcccataagcctacaatatttcctgtctggccctttacagaaaacattcacagacctctcatatgactaaggagagaggaaaaactttaagtagggtgaaaagggaaggccactgtaaaaagatgacatttgagtgaagaccagaatactaagaaggtgtcagccatgcaaaaatatagggtaaagcatcccagatagaagaaggaacaagtgcaagggccctgaggcaggatagagacagagaaaggagagtgtggcttgggagtaattaggtggtgaatgatacaaaatcaggcatcatggtaggcagagcccatgtgatggggaatctcacaagctgtggaaagggcttcctgctaacactcatgaataattctgaaaggcagcgaaggtatctgggatttgggcagcaagtggtgaaatcgtgtccacggaagagaagggacgatagcaccaccatcatgaatgaggaagtctaaaatgttgacgcttggctcaagacttctttgccaccacgaacaacatctccaagtcaagctctgccttttgttgttgtttggtttttctgagacagagtctggctctgccacctaggctggtgtgcagtggtgcgatctcgcctcacggcagcctcccaggcttaagcaatcttcccacctcagcctcctgagtagctgggactacaagtgtgcaccgccgcacctggctgatttcttattttttgtagagacagaccctcactgtgttctccttgctggtctcaaactcaagtgatcctcccatcttggcctcccaaagcgctgggattacaggcgtgaaccatcactcccagcttcaagttctgcttttcaaatgcgtcaccccacatccccaacacaaggttgcccaaatgtgcacagaagatgcttctacaacagctgaatcagcatccacatgtatcctacccacactcttttttgtatttaaaagactcactgtttcttctcttacattcgtgttttaaaaggaaccattagttcactttaaaatcacaggtttaataagccagctacatacatttcacttaaatacaaaaaggtttttttttttttaaaacgttcacctgtctaccacctcaaatcatctcagccacactctgggaaacaattgtttagagttcaaacctataggaacctcattaatttcaatccacacctaacttctgacagtactaccggagaggcgggggtttggaggacctttttattttttatttttttgagacagcgtctcactctgtcgcccaggctgaagtgcagtggtgtgatttcggctcactgcaacctctgcctcccaggttcaagcgattctcaccctcctgagtagctgggattacaggcacacaccatcacgcacagctagtttttgtatttttactagagccagaggttcgccatgttggccaggctggtcttgaactcctggcctcagatgatctgcccgcctcagcctcccaaagtgctgggattaaaggcatgagccactgcaccaggactggagtagcttttgaccaggacagtgaggacagaggacagcttgagggtgcagcacaagctctggcggcagagcttacacctgaccctgtcactttccagctgtgtgctcttgaccatgttaaatctgagagcctcagactcctgtctataaaatgagccaggctgaggggctgttgagagaattaagagatgcacctgacttggcccaggacctgacccatgctagatgctcaataaatggtcacagctctgattacaaatgcataattatttacagtcataatgatgatcatcaaaagtcctttggtctctccaaaagtgctaaaagcatctcttgtcatcaatgtgtctgagcttttgagacatctgtagccgcagcccactcaccaactgacatccccttgccgccaggggtttcgggaagctttcggccgtgtggtagttttccactgggttcaccaaactaggtctcttttttcttgctttccttttattttttgtttccaaaaggttcctgattaacaatctttcagagagggaggaggaaagaaattacagcaaatgttcctttactctggtccctgctgggctgggaggctgctatttcagactcaatcagctacctgcagggtcaatggatgaaatgcctccccatagggatcaggaggatgcagggccattgggaagcttccacagggacctgtggcctaaaaaccccaactgctcaaaagactcagggacctcaaacctaaaggggatgggagcccaatttctttaagaagcacccgtctttgaaaagcagcatttctcactctacctctgcagggggaaaggagcaacatacatcccctgaaagtaattaccttcaagttgtgaggatcaaacgccatccttaactggagataatccgaaattcactttgaaaccccctctgtccaagcaggcttaagtctctaactgcttaattcaagaaatcattaaaaatggtctttctttccttgccacaaacagagtaaggtaagagaaagacagccaagaaacctgttgaactgctgatgagaaatgcgacagcaataaaatcactggcccaaaataattctgccgcaggttaactcaacggcaagtatgttgctctcacctccaaggatggcgaattcttaagttcttttgttccaatcaccatcttccagaaatggctacattaagttgtagggcctcatgtcaaacaaaagtggcagcgaggatggttacttctgtgtgttaacttgattgggccacggggtgcccaaattaaacatgacttctgggtgcatctgtgaaggtgtttctggacgagattaacatttgaactggtgaactcagtaaagtacatggccctttccaatgtgggtggttatcagccagtagatggagggcccacaaagagggagagaaagaaatttatttttcttgcattactgcgtgagctgagacatccatctcaccttctccagctcagaccgggatttacattattggctcccttgattctcagacccttggcctgggactggatttcatgaccagctttcctgggtctccagcttgcagagagtagctgcagggacttcccaaactccataatcatgggagccaattcccataataattttttttttttttttttttttgagacagagtcttgctcggtcgcccaggctggagtgcagtggtgtgatcttggctcactgcaacctctgcctcccaggttcaagtgattctcctgcctcagccccccaagtagctgggattacaggtgcccaccaccgcgctcagctaatttttgtatttttagtagagactgggtttcaccatgttggccaggctggtcttgaactcctgacctcaagtgatctgcccacttcagcctcccaaagtgctgggattataatacacaggttgagcatccctaacccaatcatctgaaatgctccagaatctagaacgttttgagtaccaccatgatgctcaaatgaaacgctcactggaacattttggatttcagaatttcagattacgggtgctcaaccagtaagtataacacaaaatatcccaaatctgaaaagatccagaatgcacaaagattctggtcccaagcactttggttaagagacactcagcctgtacatggttctgtttccctggagaaccaaactaatacaggtgccttgttcaaaaattataaatttcaagatggcggcagcagaacattaaaccaagtgcaggcccattcctggaggggcccccagtcttgcctgcttccctttccagggtgcctctcatggctcctctccctgtattttcccaacctaaccagaccctatgatctgacaaaggaattctttttttccccaccctaatttgtgaatgtttacatatggtcttccagattcacaatccatgaacccccttgcttgcaaaaaataaaatgacataaaaacagagctaaccagccacctcagggatcctcaaaaccttttagtttgtagaccagaacctgaagcctgagcttcttttaattttcattatctcattctaagagatagtatctaaagtaaactggggctgaacagcactcataacttagctgaaaaaagaaatgtagaatgacccaaaatgtataataaatgcaaaatgagaaaagctaaacatgaaaaagctagtaatttaaaatatgtataagtaaataaaaataaaaccatctccagagcagaggtgggcaagcattttctgtaaagatccaggaatacacatttttggctctgcagcccataaagtctctgtggcagctactcagctctgcagtggaatgctgagtagccacaaaaaacaacacatacacgagtgggcgtggctgtgttccaataaagctttatttatataaacactgagctgactggatgtgtccttcaaggccttattttgctgacctatggcttagagcggcgcttctcaaacttcacgtgcacatctatcgcctgggaatcttgtgaaaatgcaaattctgactcagaaggtcgggagtggggcttgagattctgcattcctaacaagtccccaggggatgctgaggctgcgtgtccaaggaccccactttgagaagcaaaagagcacccccagaaaagaaaagaaggaaaacctactaaagaacccaaatttaagaagcacttagcagaacacagtatagaaaagtaatttattttctcatcaccaaggaacagagttatgcaatttaagtgtatcttcagaaggggaataccatgtcattggtgatcaaggatggagttaactatcattatcagaaagcaaaatgctacaccgtttttaaccaccgctgtgcattttctggtggcagttaacacggacatatagcgatcaatgcaggtaaacgaatccattcgaaggcaggccatggatggtaaatcacgttgtccaataaagttgctaaattagcaacagcgtgacacagagcattttttataaaagcgaatcctttttggaaggagatggactgcaggggtgtgtggctagcaagactggagggtggaagggagaagcagccatggctgcggatccttctggggtctggaagctctgaattttgctgggggatataatgtgaaaccggtgtggaggcttttcctgtgtgttatcaaggccccagtgagggtctgttgcccacaggcagataccaatggttgtatttcacacacagcggtatttaataaacctcttcaccatccagtttataagaagataaaaaaaaaatggctggttccactcaaacactgctggcaggaatgcagaatggcacagccactttggaagacacttcaacgatttcttaaaaagttaaatataaatttgccatgtgacccaggaatcctgctcccaggaatctacccaagagaaatgaaaacatatgtccacacccagacttctatgcaaatgctcatagcagcgttattcacaacagccccaaaagcagaaaaaacccagtgtccatcagccagtgaattagtaaataacatgccgtatatccttacagtggaatactattcagcaatatacgactacacatatagacctcaaaaacatcacgtgatagccagtgcaaaaaccacatactgcatgcttccatttatataaaatatccagaataggcagatctatagagacagcagattagcgggtgcctggaaatggactccgattggcataaggagtcttatcagggttatgaaaatgtcctaaaactagattatggtgttggttgcacagctcagtaagtttactaaaaattattgcatagaacccttgaaatgtgtaaattttacagtatgtaaatcacatctcaataaagttgtttaaaaaaatggttcccattatatctttccctttttcatcgctcacctctctagtccttaaataacatagagatcctgtagactgcaataaacccaaagacacgctggttgttctagaggaggctaaagcaagtcttccgacccaagcagatacgctggagatggcacatcaattgtcttgtcaaaagaggaaaaaaaaacacgcaagggccacgtatttgatttttacagtgaacgatgaattcatctgtggtcagagcatcactcgggcagagacgggcagtgccctcgaagatgcctccaaacccacagcctccaatcccaacccaatcccagcccaggagcttccaaagacctaagccctgaggagaatgggaatcaggagtgacggtaatgatgacaaaggctcagcccatcagctgtgttagaaaaaaaaaggaagagaaaacttgctaagtggagagccaaattcacctcgccccacatgcagccacgcccaaaactcccatgcccacccaacaagccatgtcttttgaaccatgctatcaccccgaaaagtgactcttttgaggtcacactctgatggcagaaaaaactcccatgtgcttggaaggaaatgaaaactctagtgatatacctttggcttgcctccagatggagaaagaaaatcttaagaaatgttgagctattgcaacatcccctttttgggaaaaacaatatttccagcagatgggagaatcataaaaagtaaggaagcacggtcgggaagggttgcctagaatgatccacagtgtctgcagtggccatcttcccccagcccacttcagaatccacaaacacgcatgatggtagcagccagctcagggtcaaagacagaacttggggctagaaactaggacttgggatggcccacaagtgggtccagccatgaccctggtcatctgggtgctgggtagttgagcctaccaggtacagaaggaaccccgccgaggaggctttggggtctgaagaatggaatttgggctccagcgagggacttaacagcatttcctctatagcctcaaaggtatttgaatcaggaacactagcttcacagccagaggcctgataatctccttctcccctttcattgaaaaagaaaatatctaagatactggagaatacagtaaaatccttaactctgttcccccacccccgcttttttttccttcattcctagcggcaaggctggataagcttatcaagagcaggcaaactacatcttagctctgatcctttcgagaaatccatttggcgcctttaacgtttcatttggcagattgaatttcgggcatgtatttatgggactgggtttgcccttaatagagtattgcataaatcccattacagtatccacttcagtgtgtttggggttttctaagccagggctttatctaagtggacagcatgggaatgacccactctggctcagaaactcccgcctctgccctggaaccaacctttgcagattgcctccatcatcatcaatgtcaaatgatgttttgggaaaagttctgggaagggtcagaatgaagcatgtcccatccacaaagaaggtggtgacaagcgtgtcatcacctgctagtaaattacaggatttccttccaggaaccacctcgctccacatccctcttccttctggcaacagccagagaaagtctgttatccacacaatgcctttctgtctttcgtaagtatgcaatgatgaagatgcattacttgtcatttctgaaaacaaaacaattattaagaaaagtgagctataaacaaaacagatcaggcttagcaaccctgaataagccagttctctgtaaccctcaagttaatcatttaaaaaaacaatggggccaggcacaatggctcatgcctgtaatcccaaaacttggggaggccaaggcagaaggatcacttgaggccaggagttcgagaccagcctgggtaacatagcaagaccccatttctacaaaaataatactgataattacaaaattagccaggtgtggtagcacacatctgtagccccagctacttgggaggctgatgtgggagggtctcttcagttcaggagttcagggctatagtgagctatgactgcaccactgcactctagcttgggcaacagagcgagaccctgtctctaagaaaaaaaaaaaaagaagaagaagaagaatggaattagcaatcccaacaacacaggtgtggagttttaatgcagatgaaagaagaaagcatgcttagctcacaggaggtgctcagtgacgcttggcccatgcactcatggcacacaccttagttcatctttcctagctggctctttcttggcagggctggacaggccacttacttcccaggcaacaaggcagagatgcctgtaagatgccttctgcgtacatggttcaggtccggcgtggcacgcaccatatgcaagagtcaggggttacaccaggctgaagtgtcagtacattaagaaccatttccttcctcctgggatctgtcctggaagcacgcacagaactctccattcactgacttttcacataaatagactccaaagcagaaatgcatggaaaggggctgacagcgggcctcagagccccacataaagctaaaggaaagccatttggccttctggaaccttcttttaccaaggcacactgtcccctcaccccctacaagaacccagcaatccattatctggtcactttcttctacgacacaagcaagtttttaaaaaaggcaacggcagctgcagtaaacgaagaagtgtacgtgatgagggccctttgggctatttcaggctctgtccctgcctgaaggtggctgtgggtttggttacatctaagttgggcctcagagcttgtgaaggtaaatgcttcctgatgagaaggaaaaaaaaaagtctaaggagtcttcattgattcaaccgacatctacaaagttcctactatgtgccaggctccagcaggtggccaaagggaacctggtatactaaagacctggtgccctctctccagggctgaatcctccaaggattctctcattgactttattttcatcttacatcacccgtgagcagctggggtagatgttgtgcagttactgaagaatttgtatgtactataggaggcatgaagaatgcatgactttatttacttccaactaaaggcaggaagtagtagtaatgtctccactgatatggtttggctgtgtccccacccaaatctcaccttgaattgtaataatccccacatgccaagggcggggccaggtggagataactgaatcatgggggccgtttcccccatcctgttctcatggtagggaataagtctcatgagatctgatggtttaataaatgggagttcccctgcacatgctctcttacctgccatcaagtaagacatgactttgctcctcgttcgccttctgccatgattgtgcggcctccccagccatgttagaacttcgagtcaattaaatctctttcctttataaattactcagtctcgggtatgtctttattagcagtgtgagaaaagacaattacacggtctaagagatgagcatgtcaaggcccagagagatgaagtgacttgcccaaggtcatacagacaggaaggggtaaagggatttgaaccaaggctgtctggctccagagtccccactcattgccatgatatcgccttgctttcaggagtttgctgtggtctgatctcagcactaccaccgtggctggcacatagtaggggcgtggatggcacatagtatgggcccaggcagcattggtgaaactgaatttgatcatcttatttaaagctactgcaatcacattcagcttttaagctacgggttgggaacgaggtcattctataaaaatggaaagcagaaatttaccctgaggaattttttagagttagggatagaagtccaaaagggaatctacttcaaatgaccagagagctaagacatgacctcaatacaatatgattaaatgagatgcagtggagaattacataacagttcagaaacacaatttacatctccactggtgctttcctttttattaaactagcatttctgttacgctgacaatacagaagagcaaggtcttctggaactgtttggcttacacaggcgtgagagaagtgaagacttattccattcactgggtaacatatgggtttcccagagagaaagtccacacagccatgcatgtgaaatgggtgatgataacaatagtaattgctgaccctcttgagtccttcctgggggccagacctgtgcgaaatgatccacctgcattagctcattgaatcctcatgagaaccttctgtggcaggtaaacagtatgggtcccattttacagatccgaaaactgagtgaagccgagctctaaactcaggccatctgtctgaggctctcagtccttagactacatttggaacactttactcaaagaacaccaattatgataaggaaaaaagaaaaaaaacgatgcttgccaaaatccagacatctcagacatgaaggcaagagatccggaaccatctgggcccgtgtagggtacaagctgccggcttcccactttaataccattcccttgggctaaactcccacatgtggccacagaaacccacttttcaaacccggcatcctccgcctccaatcgtatttggctccacagaagccaagaaggcatttggggacaagcaatctttatctgtaccaaatgtttattggagccactccaggaaatggtcccacgtgaagccaatgtgcacgatgtcacccacatctgcttggaatgcacttgtatctacattgcaatgctcagagttacatgtctcttgaaacgccaccctgcacagctatcacctggtccaacaagaataacagcctactgttcgtggagcggttgtttagataaagagaagagagggaaggaggaatcagatcgctccttcaaaatacctctccccatgcaccaattacagaaaattgttctgggaggcaggaggagctctccaaagtgtttaggaacacaaatctggcaagtttaaaaaatacagtgaagttcactttcctgaactccagcatcatgtcctcaaagctaaatcatactgagcagtatttgcagcaaagaggctgaatactggttgccgcacggtgcagtcagcctttctggacgggatcatacatacttaccaacagaattcttgaggtttgcagaggaaccaaaattacaaactatcagaagaagaaaaaccctcacatcaaatgcgaatggaacattcaggaagagagaaaggattaaagaaatggaaaagacgaaaacctttcccactgggtagaaggaaggagcactggtttccaaaaccactaaggggcccttaatggccagagagggagaatatttaaaaaggtctgcaattctagaatttccccacagatgagatcaggcatctgtgagacgaacctaatcgcagaggaaaacaggaagaagatgatgatgttaatagcgctctcccctaactttggtttggtggctgacccaacccatagcatttttatagccattatttcattcaatatggtaattgtgaaggtaagagatagcatgaatgaccactactcttgtacttcaccaaaaaagcctattgtatgggacactgatgtcctcattggggcaactatggccaaggtaaatgttaagtggaggccagattaaacatacgctacgtaagagtggaggactgtcagatacttgactatatgtaaggtagacactgatagcatgggtgcctgaatcagactaccagcgttcacatctgtatcagttcattcccgcatccctagaaagaacaacttgagactggataatttatgaagaaaagagatttaattgactcagttccacaggctgtacaggacgcatggctaggaggcttcagaagacttacaatcatggcagaaggtgaaggggaagcaagcatatggtggcaggagagagagagtgaagggggaggtgctacacacttcgaaaccatcagatctcatgagaactcactcattatcacgagaacagtaaggggaaagtccgcccccatgatccaatcacctcccaccaggcccctccctcaacactgggaattacaattcaacatgagatttgggtggggacacagagccaaaccatatcagcatccaagctcaacagctcacttactaggtgatcttgtatgagtcagtacacctccatgtctgttttctcatttataaattagatctgatcattgaaattaaagagttgtcataaggatgagtgcaatacagaaatattggtaaattctggtaaatacagaaatttaagctgttatcaaatcattgtcatcatcatagtggctaaaagttagtgaagcaatgatttagatcaagtatggcaggcacatggcatacgtggcacaatttcttcctcctgcatccatggtggacatggctagttgattgcagaactttgcctttaaactcagatgcagcctcagaattggtcacacagagttccagttatccccaaacaaagttgacggacagatgggtgaaagattttttgctaccctctagaacctcatcagaaaccagataaaaccagccgctcccagagaaacagtcacttcttgttggatagtggaaaagagcggctccctaaattacagtcatccttccaaagaccgacataattttgccatatctgcatgtattgtgtgctattatttatgcaatgtttatttgaatatatttaaaagagaaacttatacctgcatcccaaatgaaaaatgagttgacacaagccctaaacagaagataatgtgaaaagaaagaaaagaaaggaggaatggtactgttgtaatccggctagaaaacactgtagtagtaggttctgaatgtctgctttccattgttaaaaagggaaactgacaagttttagaaaggtgataaagatgtgctaacaacaaaccgagacttcctctttgactcaaccacttcctataagattcaatgtcatttaaattgtgccaaggtacctgtagtaggcagctcctaagatggccccaaggatacccactccagtatccccactcccacccaaatccatccggaatgtgagccagatttagtcactcacttctaataaacagaaaaaatacagaagtgatggtattccacattcaaggtttggttctaaaaagactgcagcgtattaggtgcatcttaggtgctgtctctcccatattctctcttagatccttggcttttggggaatccaactgtcatgttgtgagcttccctatggttaggacctgtaagaggcttccagctaacagccagcaaggaaggaactggggcccttggtgcaacagcccatgcaaaactgaggccagctaacaactacgtaagtgaatttggaagcaaatcctccccagtagaactttcagatgagaccaaagatctggccgtcaacatgaatgcagaatgaactgataaccttcataacattttctaattaacacatattcattgagaaagcaaagattcaagagatgcactgaaccagagcacgctgcttgctcacccatacaggcaaacaataagtggtaagtatcagaatgacttcctggatgagaattttcatgtacacatacacacataattacagtcagcacaactgcattcaatgtcagccatttctatcagctctttctcgttctttgatcttaattacatgaacaagtagcagaccatgagccttagaggcctgtggacctgagttccagtgccccctctgcccctaatgaactgtgtggccttgaaatagaaatggaatcttatccgttcatctgcagaatctggatactaagttccacttcacatgtcaatgaaaggaatagatgcatttgtatttgaatgtgattagcatggtttatggttgcctaaataaaatataagcttcctagtgtaatattctccatggactactgctctctgctacgatctataataacccaggctggagaagtccagtaggggtaagtttcacactttgggtcaggggagtcagcactgcatagaaatctaaagcaaaggtggctgaacgagaaaagctaagttccaacacttactaatggcgtggctgtgagcatggtaccgaccctcatctgtaaaacgggcataaccagtgcctacctatgttctgatggctgaatgagataatatagttaaggactcagagtagtgccaggcacacaataaaacaaacaaatgttacatattttgtcaaaattatcattaatttttttgagatgtattcttgctttgtcacccaggctggagtgcctcagctcatgcctccgcactccagcctgggcgacagaacgcctcccaggttcaagcgattctcctgcctcagcctctcgagtagctgggacgacaggaaaaattatcatttattgttattatcactatcataatttaattcataagtggttatatagagacctttatgataaatccagctcactgaaatgttttgtttggccacacagggtgttactgaaaaaaacacaaaactgaattagttgttaatatttattaaatattgcactaaaaaaaaggaaatttccggttgcttttaatacctgaaagaatggataaccctgggcctgattctcttacagtcacaggcagtggagccaagaagcaacagtccactgcctctgctcttctgtccaccaaagtcctcaccattccctatcgccctgcacctgtcctagagtaccaacttacttctcctggcctcaagggaattgggactttggactcttgttttaattccttaaagtcctgccttaaatttcaaattcttggatgatttttttaaatagcaggtactctaagtagcaatcgcaagaacagatcttgaataagattaagtctccctcaggaaatcctcagcaacactaagtgtcagataatggctgaggataaagataggatcattatcaaaaggaggataaagatccagctctctacaataaccctccacacgtgacccaaaaatgagcttccagagcttaaacgtcaaagcgttaaagttatttttgccatccccttctgtgatggttaatttaatgtatcaacttgatgtggccacagagtacccagatagtcagtcagacattcttctggggtgtctttgaggatatttctggttgagattaacatttgcactggtggctgatccacccccatgtatggtgagctcctctgcctggcttcttgagctgggaaacctgtcttttcctgcctttgagttcagatgaaaacattggcccttcccagatcttgagactgctggttttcagactggaacaacactctggccctcctgggacccagcttgccaccgcaggccttgggacttctcagccatcatacttgtatgagccaattccttataatgaaactgtatgcgtgtgtctcatatacatcccattggttgtttctctggagaaccctgactaaaaaagctgttatcaaattgatagtgcagagcttacaactcattgcagatcagaatcaaaagtgttaaagtgatttttgcccacctaccccccacctccatgatggttaattttaggtgtcaacttgactgggttatggggtgcccagatatttggtcattcttctggggtgtctgtgagggcggttctgaatgagattaacaccacatattgccccacatatttaagttgaggagcctcaactctctgcagacttatcactgccacaggctgcctggagcatttttagaccctggaggttccacagctctggattctcaatgagcccatggattcccccaccttgagagagggggcaaggaccaccccaggggatgctgggaagaactgcagagcatcctccaataagcctttgcagctctcttccctcttccccatctcctgagcccagctttctgcatcctcattcttttggaggaaagacaaaaacaagatcgccttattcctactcaaattagcaacttcatggcttaaccttcctccaaaactaaactgagagtggcaatataggggatttggattttcttcttcacatattcatctcctaaatgtttctcggtgaacgtgtgttactttaatcagcaaagatgatacaaattattgattcattctgcattcactctatgagaggcagagttagctcagcatttgaggactggacgcattggagcagaccgcttgggtgcaaatctcgactcaactctgtgacctcaggcaagggtcttaaatgcttttgtaaaataagtatgaaaattgtagttacctcacagggtggcagagattaaaagttaattgaagcaaaggaattggcatgtgcctgacaaatagtaaatgctcagtaagtacttgctacctatattatcatcattttatagtatgtatatatagtatgatataaaatataaacatacatgatatagtatctgatatggtttggctctgtgtccccacccaaatctcatctcgaactgtaatccccgtgtcgagggagggacctggtgggaagtgattggatcatgggagtgatttcccccatgctgttctcatgatagtgagcgagttctcacgagatctgatggtttaaaactgacagtttcccctgcattgtctctctctccagccaccatgtaagatgtgcctgccttcctctttgccttccaccatgattgtaagtttcctgaggcctctccagctatgcggaactgtgagtcaattaaacctcttttgtttataaattatccagcctcaggtggtacctttatagaagtgtgagaatggactaatacagcatatattaagttcctgctacatgacaggcattagaaacgtagtgatacaactaatcacctaaccccatgggtcttaacctatctagcaggagtgggacattatataaatacacacctctttctgttccaggatccaatccaaactgctttgcactttgtcatcatatctagactagagggttttctttttgaaagctcaaagctgatccttttcctgctttgagctcccaatacttttccatgacactctcaataaaatccaaactccttgctttggtctcaatctcaaagctccccatattttcacccactgacccctcttcctttcccccaccaggctcccctcactcaatgaccaccaggcacactggccgttcatcaactctttgaatcccaagcttcctccagccttcacattttctgtgcctcctggctggaaatctgtttcctcagaggtcctcataatgtttcctcttcatgtttaggtgtaagtgcgaatatcacctcctcaaggaggccttccctggtcatcccagccaaacaagtctcagcccaccatagtcaccgtctaatacacagtggtttttagaagaccactaattgctaaactaatcctatttatatgtttataatttacagtctaaccctcagtactggagtatagggaccttttctatcttgttcactactttttttgtctttttgagacaggttctcactctgtcacccaggttgcaatggtgatcacagctcactgtaacctcaaactcctgggcttcagtgatcttcctgcctcaacctcccaagaagttgggactacagacacatgccaccatgtccagctaacttcttcttcttttttttttttttaatagagacagagtctcactatgttgcccaggctggtctggaattcctggtctcaagtgatcctcccgccttggcctccaaagtgctgggactacaggcacaagacaccatgcccagctcaccattttattgtaggtgcctaggagagcatgctgcacatagtagatgctcaataaatatttgttaaaataaatactattggaaggaatgaatggatgaaggacaggcatatattttcaaatgttcacagatgtgtcgcaagaacctagtgcagtgcctggcacatagtaggtgctcaatgagtacttgtcaaaatacagactgagggaatgaatggataaagggcagacatgcactttcaaatgttcattgatgtgtccctagaacctagctatggcacctggagcatagtaggtgctcactaaatatttggtaaaataaaaatgggttagaagagtgaatggatgaagggaggacaccatttgtttttttagacagggtctcactctatcacccagactgaagtgcagtagcacgatctcagctcactacaacctttgcctccagggctcaaacaatcctctcacctcatcctcccaagtagctaggaccacaggcaccaacatgccaggctaattgtttgatttttggaaagacagggtttcactatgttacccaggctggtctcaaggagcctgagcttaagagatcttcctgcctcagcctcccaaagtgctgggattacaggcatcagccacacttgttcactgatacgtcccaagaacctagcccagtgcctggcacgtagaggctgctccataaatattaatatttgtcagatgaatggcatttgagtgagcaccatccattgttaaagaaagaggtgaccacatagagtgagtcggctggaggccactcttctgcccaagggcctctctcaagaagtcaccagaaaggaaggctgggagcccttcctggcagctgccagaacatctgtctagagaggccccgggctcacctgggctgcgtggaggcctgggctgggctcttttgagcgactctcactactggctcaggaagttccacccagtgccgccccagcatggaggctcctctgtggcctcaatgcaaactcgcctcagaaaaggcagctgattaacacgcgtggagggtctattgtctgaatcccgtcaccagcggagaaacagctgtttatagtttgtttattcctctccctttggagcccacgggaggaaacacaagcgcttgttctcaggggcaccattcagcagctgaagtgagtgaagaaaacggtgtttatttttaatgggataaagagggggaactcttacaaagtttggacactagcagggagaccgctcttcaggaggcaccaggccttgtggtgatgtgttgcaccctgcctctcgagggatgctcaagagtctattccaactcccagctggaaactcaggctcgggccacggtggtcggtcaaacagtagacttgggtgagcacctatagatatgagagatctagaaaagctcgtcaggcttgaaaatgagagagcaagatttctttggagagcaaccacctgctatttaatataggtgacatcctataaagggctgccaagcccagttgtgcaggctgggcactgcacaaaggtgtccagctgagggagaaatccagcctctgtgagctgctcatcaagccatgctccacagtttcaaaaataaatacatacataaataaagatgactaagtgagacaacagcagtctcacagatatatagatgtatttatgtacttcatctttaaatgctcacttattgactcttcacaataacctttcagattagggaccactgtcatcctcactttacagatggcacactgaggcagagagagggaacctgactgctccaagctcatccaattaggaaggagtgaatccaggattcaaacccaggctcttggtttccatcaacaggtgatgctgcctcttctaggaaaaaaaaatggctcaacaagccccagagtgtcatattcagaaaacacagtgcccctcccagtcttgggagtgagacctgctttcagaaacacccatgtcttccctcgattctgcaggtgatcaggctggaaggaggtaggcgaagaccccatcgtctgcattacaaggaactccttctaaagactcaaaagatttgctctgaactggtgaaagtctggggactcccactcagcctggagactcaaccaaccctcagcggggaacagcccaacccaaccagagctgaggccacccgctgctcccttctcagggcccagggtcagccaaggccattttcaagtgcgggggactgcagccaaactcgctgaaccagacccaggggagcccaagagggacctctggactcaagggaagaggacgctctcatccctgtctactctcccacccaccccctcctcccctccatccctccctccttcggagagcctccacattcgaatctccgaaaatggttttcacaactcagttagcagcaatcaattattcacgacctcgcttccccaccaactcatagactgtcactgttagcaagataatttctggactctgcccaacagccctgctctaaaccaagcggcctgctatttatttcctctcttccctaagaccctcccaatgcccaccaaccactatcactctcaacacaggacagagagacagatgggaagtcccctgggtgcctgtagcctgggagggacctgacagccaggggctgctcccagcccacgtgatacatttcaggcttggggcagaatgtctgaccttagtttaatccaactggaaaacaggactcaagcattctagaccctgtgccaggctctgggacaaatcccacattattttataaaacgctttaagctccgaaaacattgtgtcctgcacaaagcatgacttgggagggtctcccagacatgccgtcctgctgctgagttcatgggtcaaagacatttggaacttggcaggggctcatattttaagactaccactagcatttccatcctagaagcttgaagctgtctttaggaacatattcctacatcccagggagaaggagagaggtgcttatgggatgctcttggaaaaagagtttcagcctatgtcgtaagacccatggagggtggttggatagcagctctgctgtgtgaacaagcgaccttccacgaaagccacttttcaccctctaagcctcaatgtccacatttgtaaaatgggagaatatgagtactacttctggggctgcagtaagagttttaaaaaatgaggcatttaaaaaacacccagtaccttgcttggcacattgtggacattgtggcctctgtgcttcattgtaagaccctgtcgcttgtgacatgcatcattgattgaataacaatttggggcaaaagggtgtgtgctgaaacattaaggaaacatacacatcaattgtaaaattcatcccagatttcagaaaggctatttactaaatattaaaaatgtgtatctttggccagatgtggtggctcacacctgtaatcccaccactctgggaggccaaggcgggtggatcacttgaggtcaggagttcaagaccagcctggccaacatagtgaaaccccatctctactaaaaatacaaaaattagccaggcgtgatggcacatgcctaaaatcccagctacttgggaggctgaggcagaattgcttgaacccgggaggcggaggttgcagtgagccgagattgcgccactgcactccagcctgggcgcagacagagcaagactctgtctcaaaaataaaataaaataaaatggctgtgagcctgggcgacacagtaaaaaatgtgcatcttaaaatgaagcatattatcattattatcattattacaattgctgtattcattttaggtgggaaaatgcatacagagaagctatgtgactgaccgcaggccacacagccagcaacacaatctagtccccacacagctccagaggaaggagggagaggaagaggcagagttgaccaggcaaatctccctcatccaattcctcctcctcctacaagaatcaacagtaataataataatggaagatgagggtgaggggaggtggaggggggaggaggaagaggggggaggaggaagagggggaaggggaggagggtggaggaggaggagggcagaggaagaggaagaggaggaggaagcagcagcagcagcatgttatggtgcttaatacaggcccagacactgtgctaaatgaggtgcatgtattaactcatttatttctcctgacaaccctttgaagtgggttcatcatcatccccattttacagatgaaggagctgaggcacaaagacttcagtcacacagctgctgggtggcagagccaggctgcgaactccggcaccttggcgccaagtccccgtgcttctctactgcattgcacttcattccaccaactgagacaaagagggacgttttggtggagaaggaagtggcatataagtgtcatgccatgcctggtctcacccacacgcccaaggaagttcctctgaacccacagagcatgccctgggctccctctgatgaaagcaagttcatgcctctcttccactctctcctgctgccccaggccagctgagcaggccaaaggagggctggggccaaatctgcagccccatcctggggaaaggctctgacgacagtagccagcttctcactgctgtctgcaggatctcagcaattccacgggcatggagaacagcagcccctggagagggtaggagaagattgggtgtctgccaggcctgcagctgtggacacttcccctatgggctgcggggacggggcaggcccagcacctggaagagggcgcctcccctgtctggctggtcttcagtcccatcaacgggacttagcatcaagtgacgtggtggttatgcacacgggcttgtggggagctgtgcaaccttgcgagagttacttcccctctctgtgcctcacttcctctgtccataaaacagtgactctgacaatgctgacaacactaggtgttggaagcattaaatataaaacgcctaacatgtagtatgtgcttaataaatggtagctgctaattactattatttatcatcatcaacaggactatgcatcaactactaagaacacaggtggaccttaaggtgccatcagtatgggtgaggagctgacaagaacccatggaacaaggcatgattccttgttctagaatatctttggcctttggatcttaaaatgtcatcttaaagtggggttccatagctctcacttttaagacatctcatctgatctttcaggcaatttctgaaggaaacaaaaatatttactgagcacctattgtgtgccattcactgtttccaccactgggaataacctgatggagttaatgaatccaagaccagctatgatggtgatggcagttactaataaaaggtgagaaggaccgggagtggtggctcacacctgtaatccagcactttgggaggtggaggcaggcagatcacttgaggtcaggagttcaagaccagcctggccaacatggtgaaaccccacctctactaaaaatacaaaaattagccaggcatggtggcaggcgcctgtaatcccagctactcaggaggctgaggcaggagaatcgcttgaacccaggaggcagaggttgcagtgagctgagattgcgccactgcactccaatctgggcaacagagcgagactccgtctcaaaacaaacaaacaaacaaacaaacaaaaaaaaaaaggtgagaaggattctagagtttattgttaggtagaagtgggaggtactgggaggaaaggactcttttctgcagacaatcacaccaaaacagccacgtacacatggaagtgggaaaggacacgtgggtcacacacacggctggaagaagagacatgtgcaatcagggcacaggtaaccacaagagacctaaaagttcagagcacaagggacccagaatccctcagaccattttaaagacggggaaacagagaacctgaaaggcaggcagcccaaagccacaccaagcaagacacagaacaggttctggaatccaggtatcctgactcctgaaagtcgagatcactttgtcttgcgtcgtaaacagactaagacattccagcacagcacagcccgccatcacagacagacactgctgccaggtcaggcagcccccatctgccatctctctagatcagtgttaccaagctgaggggagtgtaagacaccaccaccctcaaaatcaaacaccttaggacaggaccaaagacaggtaagttttgacatggagatgagggagagaagttccgagttggggacatcatcattctgcaggggcaggtggggaatcgaaaaagccgttgcatgcaaaggacaaatgttctttcattggaggtggagtgataataactgcagagggactctgggaaggttgttggacagagtgatttttgtcttcaaagaacgtgatcaactttttgcaagtgttcaagttccacctccaaatcttgcaatttctaaaccagtcaacttttctaggtttttaataaaacagagatgatgaacccattagcagggctgttgggaacctcaccccagaaaacagttgatggtggcctggaagcccctgcaggctcttgttcctgtccttcttcccaaatgactttcatgtccttgtcataatgaccacattgtttacctcctctccccgcaatccatgccggactatcttctctttgtttcatcttaaatgtcaccttgttggaaaagccttcccagatgaccctccccttctccctgactcactgtcccctccatcggaacctgagctgcaggaagtcagggaacgcgttctgtccactgctccaaccccagctcccgtgcagtgactggcacctagtaggctcttggtaaaatctgttgagtgaatgaataagtgtctgcaaacatcctgggtacatctgtaaagcatgcactcatagaaaacttctactatgtgacacacagtagattatcaatggctgttgctgagaggacatcaaagtcaattccaaaccaacaaggtcggcttcccatttccgctgtggagtagccttgagcttagtgagatagaagactcttgcccatcaccccagggacctgctccccagagctcaaggcactcagtaatgaggaaaaccctggctttacaagacacagtaaggcatgaaaactggggagaaagttcactgggaacctgcaggacactacaggtattctacaaaatgataagctactctgccattcttaactattcttaaaaatgagaggaaattgatcagcagaaaaaaggtacatgaagtgtgctgtgttttgatgtgggcaggctaagtgataacttcccctaacccgcccatcctaataacatgaaaccagtggtgcctcctgctactgacaggttcccttactcaattgctataagagaagcattgagcaagcattgagaattaaggaacctacagcctattcatagattctaaccctaagaggaacgaaattagcactttgtatggttgggtcattaaaggatctcatgaattaatactatcgtgtttgcattctgttttgtgaatttctgcctttatttttcttaatgtccctttcctactttcttttgtttgattctcagtttttttctttttttttttttttttgttagtaacagggtctcaggcctggcaccatggctcacacctataatcccaaaactttgagaggccaaggcaggagggtggcttcagaccaaggagttcgagaccatcccagcctcaattatttttttaatggacttttattttaattattttactctttcatatttaatgtcaaaacctaaagtgcttttaaaatagactaccagttttcctctgggcacagttttaaccttatctcaagttttgatatgaagtattttcattttcgctaatcaatatataatctgaaatgtcaaatttaatctattcattgatctaagaattacttagaagagtttcgattgtttaaatttctatgcgattgtcttttagaggctaattttcaatatatcttattgttttatgaaggaagcctggaagttttctacttttgaaatctattaagattctttttagaccaagttaattatcagttgtaattagcacgttagaacatctagaaagtagtctttaaaaagagaagttcttcccctagaatacacacacacacacatacacacacacacctttgtaaagagtttcaatgaatacttacaattctagtcttaccttaacaaaagtaaatattccaacagaaaaagacaacctattaagctaaagggaaaggaggcaaactaccagaatttaagggttaagtttctcacatctgggaattccactctggaatcataaccacaatagcattgcagctttgcagccctattttaaagacgaaaactgaggcttccagatcctgagtcacatagaaaggattttagctgagcccaagggtttcaagtccacaaatcctttctgcactaaattcaaatttcattccaaaagtaatactaaaacagcagctgaccttcttctcttgtgccattccttaagtttgttcatcgcaccaggcagaatcagaagacaggctcctacaacagctagggctttactcctggtaaagtgggttggcttaggagaagaacggacaggactctttgacaagccccagaaagaatattaagtcatttttcagccagcaccaagcaaacctgaaagatgggtggatcctagggtatcctaattttactcttccaaccctgtcagtgctagtgtccaaaaagtggagcagcaaatgggaagtgactggcattcagaaactgacacaggatcctgcatttctaaacaatgctgacaacgcacactgaggcagcacctccggggaagtctccgtgctccgatgctgtggccatgtacagcatatgcagtccccaaagggatatttcagcacagagtttcaatgtaaaatgacacacgctactgcaggctagagatcttattggggacacagggctatattcatctgcttcccagcaagaaaaccagaaagccagagataaacagaagtcaatcaaagcagaaagtgacatctagaaaaaaaacacctaattctgccaaacctgttttgctgaataaagataagagcgctgtggacaatatggctttggtataagaaattaaatgatggcaccattcccaaaagcaactaaagcagttgacatcgggcttgttcccaacagcctagaagggactaagaatggaagaacaatggacaattaagaaactgtttctacggactctgaattttgcaagactaattatgaaaataagccttgttacagagtttcagcatttgaaagtattactgtgctttacttcctactctgaaaggtaagacttccaaattaaaatataattgtcaaatcaattggtaaaaaaaaagtagttaaattaattccgctcctaggtatatactcaacagaaatgtttgcatatgtttgccgaaagagatgtccaagaatgttcacagcagcactatttataatggccccaaactgggaacttcccaaatgcccataaacagaatggatatgtaaattgtggtatattccacaatgaaataatgcaaatgaacaattacaactctgtgaaccaatatagacatagggttagcaaactttttggtaacaggccagatagtaaatgttttaggcttagggcccatacagtctttgttgcaactactcaattgtgctgtcatagcacaaaagcggccatagctgatatataaatgaaatggacatggctgtgttccaataaagctttatttatgatcgcaattttttttttttttttgagatacagtgttactctgtcatccaggctgaagtacagtggcacaatcttggctcagtgcaatctctgcctcccgggttcaagtgattctcctgcctcagccacctgagtagctgggattacaggcatcaaccaccacacccagctatttttttgtaccttttagtagagatggggtttcaaccatgttggtcaggctggtagcaaacttctggccccaagtgacccacccacctcggccccacaaagtgctgggattacaggcatgagccaccatgcccagtcaatttgtggacacaaatttgaatttcatataattttcacgcgtcacaaaatatcattctttcctcccccccccgcccccccccgcaactatttaaaaacataaaatccatccttagctcacaggccatatgaaaacaggcaaaggaccagatttggcttgtaagctggggttcgccaaccctggacagagataaaactcccagacgcaatgttaaccaaaacaaaccaggcacaaaagagtacagactgtatgattccatttctaaaaagaggcaaaagtacctggtggggttagaagtcacgatagagaccctatccttgcaggcatggggtcagagtggacgtggccgggatcccgggggctggtgggctctgaattcgggtgctggttagttgggcgtgatccctttctggagctgtttattcatgatttctgcattctttctcatgcatgttctacttcaagagaagtttagcaagtttttataataaagtagcttacaattcaatcagcttcaaaaacagaagtataaagagaacgagagcaatcaaattaaattagttatgacttcttcatgatggccaggtacctgccaatgctagagtacttaagaatatttaataataatggctgggcacagcagctcacacctgtaatcccagcactctgggaggcctaggtgggcgaatcacttgaggtcagaagtccgagaccagcctaggcaacagtgagactccatctctaaataaataaataaataaataaataaataaataaataaataaaaggtagatttaaattgttttcctctattattgtgtttacttccagggtggagtttgtttcatggtttaagggatggtgctaccatcagaatccggccaggctattttctgcggcgtctgcgcataaagatgatgttcacccaattaccagcgactcctcgcatggaaatctaccatcaatactattaacataaacagcatctggcaaaatacatggccttcaacctacagcaaaacctgcgctggactctcacaaaggaaaaaggccaggtctggcttccatttgatttccagagaatacgcaattaattattttttctcaccgtcagcagctgagtctcagtgaaatccgtgcttgtaattatcgctgtaattattattttaatacaaatcagcaacttatcaaaatattacgtgtcaggtgctacctctctgctgcaagactatggatggaaggtggaggccgtcaccccagcttcactctgtgcacacagaggatgggaatcagggtgagggtacttctaccagagccagactttcagcttcctagatgtccacgtccacagtcagtttcacactcgaccttttttttacaggcaataagtcactctgtacattctatgtggtggtttgatcttgggcaattcagttcactcactgctaggtctcagtggtaccatctttgcagcaggcaaacagtacaaaccttttttttttttttttttttttggagacaggatcttgctcggtcacccaggctggagtgcagtggtgcgatcacggctcacagcagcctcaacctcccagggtcaagtgatcctcccacctcagcctcccaagtagctggaactacaggcatgctaccatgcccagctgattgattgttttatgtttttgtaaagacgaggtcccactatgttgcccaggctggtcttgaactcctgggctccagcgatcttcccacctaggcctcccaaagcgctgggattacaggcatgtgccaccacgcccggcaacagtaccaactttctggcagtgtccttctgaagaaaacctaatgggagttgttacatctttctgtgcggcacatgcatggcatttgacacacaggctcctgagtcacgctggctgagttgaaattccaagtcttctctgtgactgcaggtgatttcttaccctctctatgcctcaatttcctcatctgtagatgggaatactatcagcagccacatcataaggctgatataatgattaaaatgataatctaggagacgctgctcagtacagcacagtgcctgccacgtagtgacatctaatagataatagcaattattattattatcattctgaaagttgcaaactcaaaccccaacagccatcttgtgggtaacacagacaagtaaagtgacctggtgggcccgtgtacacgaggcagccacatcccccctcactcaaatggttacctctgggaatgaagaccagaatttcgaatttcttaataggcactctaaatttgatttggattggaaatcattgattttggctactaattcaagttttgatttttaaaatttaccttttctttaagaaaggaggaagaggaccctatgctgtcattattccatctggagcccacacctgactcacaaagctctaggtttccttctggcttacgtatttcccatcgctgctttctagcacccaccttcattggagggctgtatctgcctgctcactccaataaacagtcagtttcctccaaatgttgctgttgtgcgttttttgtttgctttaattctaaaagaaagccaaacagcagtcagcctccaggccaaagaagaatgaataacctaacttctacccatttctaaaccacccagtctttcactgaacatccttccttaggagacgtttagcttaacatctctccctgctttctgtctttaactcaccttctaaacaagagaaaatcagacgtcacaatttgaaaactatccctcaatagggttacaagaaaaagcaggcaataagagcattttacatccacaacagaatcatctgcaatacttgatgacaagcaaacggggttctcagtgtctttcataacagctgccccttttgagctaggataaaagaaagtgcaaaagagagacaatgaataggcttttatttcaaagagaacatctgcaaagcatagtcctccattaaaaaataaacagaaaacagccactagtctggggaaaaaaataagatttcccattacatctctaattaataaagccccatttcaaaaggaaaaaagaagaagaaaaaaaagaataactttttcacatccccaaagaaaggatgcttaatgaggtaactgttgtattacttgatccatctagtctggttttaatactatccttaaataatgtatacattagctttccattaccaaaaacatttgtttattttatgaacgtgagtctggttgagagctgagactctgcaaaattatcatgccgtccttgggctcccggcttttattgcttctcccctcgctcattatgaaatgattagttgtctccgatgcccttttgaattgctgctaacgttgtactgcggttctgttaccctggttctgaataggagagtcttggttcagggttaagttaatgtagtcattactggcccatttggggacccattcatcatgctaatttcatgtccaacacttgggggaatagagtacaaatactcaacgtgaagcaaatgcacagtgaatccaaaagacgcacatgaaatgtccagaactcagtcacagaagacaggcatggggagctctggggccattactttccataactgtgggagcaatgcagacatcagagagggcctccaatggggaattcctttccaagggacccagagcacagttcctcctaacatctaactttaatcctttccacttgaacttcagaacaaaacagcacagctgtttaccagaggagcaaagactcttcaaactggttaagttgacattgaccaaaccttggccatctcagcacttccttgatcgtcattaaccaaccaagctgcaatcaggatttgaaatccagttagagtttgcttatgtgttttcattttgttaacccacttcttcttacttaaatgccactttacctgcatgttaaacgagaagagtgttgaagctgccgttttgattggctggttatatttctgtattttccataatatacatttaaagaaatatacagcgattaataatttctttaaatattcacccaagaagaagagagtgcatctgggatgttgtcagtgctatgattcctggtctaggatactcggatgtgttcagtttgtgagaattcatcaagttgtatatttagagtaatgtttgtatcatatggttttgttgggaaaaaagcaactaaaagaacgcaggcaatatttaagaagtgagccagacgtggtggctcacgcctgtaatcccagcagtttgggaggctgaggtgggaggatcacttgatcccaggagttccagaccagcctgggcaacatagcaaaaccccacctcttcaaaaaatacaaaaattagccgggcatggtggcacgcacctgtagtcccacctactcagggggctgaggtgggaggactgcttgagcctgcgaggtcaaggttgcagtgagctgagatcaaaccactgcattctagccggggtgacgtaaggagtccctgtctcaataaattaacaaataaatttaagaagtgaataaatgttgtacagatacgaatagtaactttttataaagagtttttacagaatatctgcccttgtagcacctccaaccactggtgcatcacgattggtgtctataccatattttggattcctggggctcgtttaggactactatggcaaaaggcatgatccaaaataaatccttacccctgaataagtaaaataaatccacccatccaaaacaaatgcttatccacagctctttcttttcgttcagctccctaatggtttccttcgctgcatttgtaacaatctgattttttgcaatgttcttgtttgtttttattgggaggtcatcctgcccccaaaccataaagagcatgagggcagggtcacatctgtctttccccctgctgtgcataaggcctggcacacagcagaccccaaccagtatctgatgaatgaatggatgagtaggtgggaaatttccagtggatttcactcattcattctctccctgtcccccacgggttacaagacgctgtgaggaaggaacgcagacaaccccgtctgaacactcccacattgtgctgcttgaagacatgagccccgtcttccattcacatggggctttctgagcttcaaagcactttctcatctgtttatcaaatttaatcctcacaacccagggagggaggcaggcttattagcatcatctgatgaagtgccaaaaagacacagagatgaaagtcacggtccgtccctgacagcgctgggaccaagccaaggtgctcaggaatgttctacttttccacctcccccttgtctctaaagactcccaacttcccaatgcgtgttattgggggacaaggtcacgggaaacacagagtgaggggcagatgactcaaaggaggctgtcactcacactccctgcagaggggaaacaggtttatcaaattgcggaatgcatgattctatttctgtcggggacatttgccttcaggatggcctcatgcttataagaatttgcatattctgggtctccaccaccagctaggcggggagggagactccatcatgccagggcaaggcacaggcagtgagaggcaaataagtgcagtgaataagccacatgggaatagggtaaccacagatgctcatttttatgtcttcatagtgaacacggaggtcttccaaatgggctgcaaactcaacagccaagaggggccagccaggtgccacaggtgacaggagagatcttagggggactcttagggacccagtgggtctgcagtatcaccattcctcagcttggctgtttaacaccaagcaagcaccgtggaccctgtattgccggatcttatgacttttaaaagaattccaaaaatctacgctgtctcacggcatatcctaatctttaaattccagggcctatttattctaacacaccgtgtggacaaaatcaaacccacccacgggccatggatttgaaagtcctcctggctctagcaaacatctcctacgatgtggctgcatcaggtggcagagcagagcactgaccatgacccagagctgtgcctcaccatcaagccctgccaggtaggtgccatcatggcccctgtgcttcagacaaggagactgagctccagagaggcaaagtgccataccaccgatgatgtcagaccactgtcttcttcctcaacatcacacgacctgcctcccaggccccacagcatctgcccatctgctcccctggatcatttccagggttgtttcatgagctacaagaagaagagcttgggccccatgagcagagcagcccaggcctcatggacagttctgggatggcagagacctcagggctcccagggctctgaatcatactacttactccttgccctgaccttcccagaggacacctcccttgtgtgttcaagaggtcaccatgggaaagggtataggcaatgaaccaggctaggatgtgagagtgatctccctagagatcggccacttatcagcacgggctctaactcttgcctgctagactggtcctcctggagggcaggaggcacattggtcctgttcaccaaggtggttccagtgctggacacagggactggtaccttctaactgcaggagtggaggatgggtagataggtggatgaatggatcgatgggtaaatggatggacagatggatggatgaatggacagaggatggatgaatggacggatagatggatggatggatgcttagacaaatagatgaatggactgatggatggatggatggatggatgggtggacaaatgcatgcataaatagatggaggcagggggagaatgaggggctagagtcaacggacttactgactctgaactgggtagactgagaacacagcctttggagacaccacccaacttcaatttctagtttggacacttcacatctgcttaattttcatccaacttattgccttagttttcattatttcaatcagtaaaacagaaatgaaaataatagctcttaacttgccagatgttataagaattcaataaaagcatgtctttttagtccttccacagtgtttggtgcattcgataaatgcacctcatcatcaccatagttgcaatgtttgtgcctcctgggtagggaacatttgcatcaacctctctgccccacaaactcatcttaaactgaaaccacacatcttgtggccaaaaattatggcaaagcgtgccctgggaggagaaacaaatgcctcttaccacattacctcattagcatccactgacacattagcctggattagatgtccagataagcagtagtcacctggctgggacaaactaggcctgggacaggacaaatccattcattgcccctaggtggccctgaaagatgagacaccctcgtccacacacacaaagcttgagaatgggtcccaccccttcctcatctggcagggtgtctgggtttgcagttcctgacactaataatgccagtgtccaggttcagggctaaggtgacaccccaccccacacccatcttctttgtgatgcctctggcttccaatcgggaagggggcaaccgaacccagagagcacatgggcaccatctgatgagcatctgcgggcaaacgggtagtttctgttgcaggcggaaggaagtgtccgcaagatgatccgcactgcatgtttattgaggtaactctccagtgtgctgcagacccaggctctcaggtacaagtggcgggctcctcagtgggccaaccacagagcggtctgaaggaatggagcagcaggaagtctgttgtggttgaaagaaaggccattgtccccggccaaagaaccctgaacaatatcctcttgccccctcctccgcttctcccttggttagagagagctgaattcaagactcctctctctagccaatttcaacttccattcttgactgttgaaaatataatagtacacagcttgaaggattaaatgagttcatgcacaaagagggtttagaacagtgcctggcaaacagaatagagaacgcagaaataaacccacactttaatatcaactcatttttgacaaaggctggggaaaggaaagtcttcgataagtagtgctggaaaaacgggatagccattacctatggataaacttaagaatgaaactaggccccatcactcaccatacacaaaaaccaaatcaaaatagattaaagacttaaatctaagacccgagactatgagacgactagagaaaaaaacattggggagacacttcaggacgctgagcaagaattttttttgggtaagaccacaaaagcacaggcaacaaaagcaaaaatagacaaacgggatcacatcaagctacaaagcttctgcacggcaaacaatcaacaaattaaataatctacaaaatggaagaaaatatttgcaaactacccatctgacaagggattaataaccaaaatatataaagaactcaaacaactcaacagcaaaaaaacaagtagtccaattttttaaacaggcaaaagagctgaacagatatttctcaaaagaagacatacgaatggccaatggatatataaaaaaatgcacagcatcactaatcaccagggaactgtgagtcaaaagcacagtgagatatcatctcaccccacctgaaagggcttttatcaagaagacaaaaaataacagacgctggtgaggatgtgagaaaatggaacactcatacactgttggtgggaatgtaaattagtacagccactatggagaagagtatgaaggttcttcacaagctaaaaacagaactaccatatgatctggcaatcccactactgtgtctacacaggaaaggattaattatccaaaggaaaggaaatcaataaatccaagagctatctgcactcccatgcttactgcaacattcttcacaatagccaagatatgaaatcaagttaagtgcccatcggtggatgaatggataaagaaaatgtggtaaacacacacagtggaatattagccagctgttaaaaagtgaaatcctgtcatttgcagcaacatgaataaaccggaggccatcatactaactgaaataagccaggcacttagagacaaatatcacatgttctcactcctatgtaggagctaaaaaaagtagatgacaagaagatagagagtagataggtgattaggggagtagggaggaagatgttgattggaaggataaaaatccagttagatagaaggaataagctctagtgtttggtagtccagtagggtgattatcattaacaataatctattgtatatttcaaaatagctagaagacccgggcacagtggctcacatctataatcccagcactttgggaggccaaggcaggcagatcacctgaggccaggagtttaagaccagcctggccaacacggcaaaacctcatctctactaaaaatacaaacagaattagccaggtgtggtggcgggtgcctgtaatcccagctaatcaggaggctgaggcaggagaattgcttgaacctgagaggcggaggtagcagtgagtcaagattgtgccactgcactccaggccgggcaacagagcaaaactgtctcaaaaaaaaaaaaaaaaaaaggagctagaagagaagaatttcagtgtctctgacaaaaaagtaaagataaatgttggcggtaatgaatatcccaattactttaagttaatcattacacattatatgaacctatcaaaatatcacatgtaccccaaaatatgtcaaactattatatatccatttttaaaaccacctaacacatcataactgccatgcagtcattattattattattatcattattactacccttgtatttgcatcatgagttaggggtctgattcaatataaattgcatgtctgcttcttttctagggttggtaactttttaggaatctgcaacaagaagtgagaaaagtagaataaagatttttggggctgggcaaagtggctcaggcctgtagtcccagcattttgggaggccgaggcgggcggatcacgaggccaggagttcgagagcagcctggccaacatggtgaaaccctgtctctactaaaatacaaaaattagccaggcgtggtggtgcacgcctgtaatcccagctactcaggaggctgaggcacaagaattgcttgaacctaggaggcggaggttgcagtgagccgagatcacgccactgccctccagcctgggtgacagagcaagatgctgtctcaaaaaaaaaaaaaaaaaaaaaaaaaaaagatttttgggaatgcatggttgcatttagggtttttcaacaaaccatgcaaaaggaacgcaactcggaaaggtggcatctttggaaaggggcaggcctgggtttggatctcagttctgctactccccagctctgtgaacttcatgagcaagcagcttcacttctttgagcttcagtttcctcctggggacagcaaaagtcttatcccacaaagttgggagaaatcagtaagacagtaaggtaacatttacaaatccctccattattcctgccacataacaagccatcataagaccagcgatttctagttgggtgtccttagttttaactttttatcagttgtgtaataccgtcttccttcctggaaattttttgtgtttttttttggggggggggggggtgagcatttaataacctaacgtatgcaaaatacctaaatgacacctgacatacagcaggcactcaataaatgtcagtactccttcctctaccacattccgtcctgctcacacagaaacagctatattcattctactgccttggatttactcgcaccctacactgtacgggaaaatgaataactgcaagaaattccttattttcaaacataccaagaatttccttttaagaacagctcatttttgaacactgattaaggaacaggcccacatgagttcacatatattgctacatttcatcctcatacagccctatgaggtagctcagattcacagaggaccgaaattacagtgacttgcccaagattaggggcatgagaaagggccgagccaggaggtgaacccaggtatgtcaggcctgagggtactcaacagaggcctctttcattggtgccggggcctcgcacatacttgttgggacgttttctcctgttcccacaccccttccttagaatgcaggttttgttaagatcgagtttgttttttagttattttttattttccccaaggcattttctctttgtttctggtagatggggatctgggtccgcagaaatggggaaatgcaaaggaaaaggaaagagagagatcataagtggcagctcttaaggtagcactggtcaaaagatagagactctcaacctcacctgtgcagtccaacaggtgtgtgtgttaagttcttctgcactgaaacactcatatagatggatttatgaccttatggatcataaacagctctggagcggggtgtggggggcagactcttatgtcagagatatgcctaaggatatctttgctttctgaggatacacacacacatacacaatgacgcgatgatgtcaaatctctgctttaactcaagccaccaaatttcctcttctattaaaaccatgaatcaaacttgaacagtcaccagtaaataagaacttacgccatggctggcttcctaggtgaaaaatagcaagcctttgaccacccacccttctggaagatttttaaaaaatgaattgataaactgaagagaacgtctaaagtatgaaaagaccggaaggaaagtgaatacatagatatattagaattcatattacaaacatatctatacctacgtatattatttctacttttatttatctattttaacactttccatgataaacagatggcaacatttgcagtaagataaatattattcaatgatgcatatttctgtatacaaagtgtaatgcgtcgctcaaacaaaacaaaactccattgaaagtgtgaaaaaaaaaacgaaccatcaataacataccctgttttctgtggtctcagaacatctggataggaagaaaagctatacctccaaggctgttagaagcagaggtgatctaaagccagtgaaccgatctttcaaagtcactgctgatgtctaaaagagtcctgagttatctgagtaatgtgaagcatgaggaatttctgccgaaaaatcaacatttcaaaggcgtcggataatacagaaaccccattctactttgtgtgcttatgtagggcggcaggcggggggtgggaagggtaataaaaaattagatttcttaaatgaaacttactgagtaacagtttatctaagaacacgagcaataaatgtggggacttcaagaagagtcactaagggaaagaaaataaacattcattacattaacacacgcagctctctttcattttctccaaaatctattcagaacctgtaggctgatccttgtgacagttctcccaatatttttcctccctttataagggagtccatctgtttcttaaattctgagatgacagtaaaatccacagcttactggagacccagtgaaggaatcagtgtcagccacaaaacagctgcaatccacccaataattctaatatttaagagctttaaaagaggctgagaggaaaaggagagcttgcaaatcttttatggacatgccctctgactctgtctacttgagaaacggggtgtttcctcttggcttcttaagtgcaccaaaaatacaatcagggccttccaccgaagcgcagctccccaaacataaaaaggacaaatgctctgaggctgtgggcatcaggaaggaggaagatctggcttaggaaatgccctatacacaatgcctgcctgacactctctgcaacacacccaccagcaacccaggacacaggttccctctacatgcaagagccaaggctgtccacccaccccatccccacctgcaacagagcactgagctaaagcatcttcttctaagcatgtgtctaaccacctctctacaagagccatctggaaaatcacggggatttgtttctttaaatgtcccactcctgaatctccctccaaagcatcatcctggcagcctccgcagggtctggaaacaaactgcacatttcaacggcctctattgcttgcgaaaaggtctggtcctctccttgcctgcaacccaagctccagctataccagactttgggaacagcctgcccccttctggtctcctggagctccatggaagggcaggaactgggtgggcacagtcagagtaggacagaccccgggctccagccagcctgtctgtactgtgatttcaggatttagcaggtcatggagtaggtgtggggggagaggaaagaaaggagacaagcaaatgaaataaaatacaaagccccaagagacaacagtcaacagcatggtagacagccaccaagaagagaagagaaccaaaagaaaaaaaaaatacataaatgtccatcttggaaggtaaagaaattgagacattaggacatgcagatttggggagagtaactgaacttgcagttggaagcagagtttcagaaaagcaaagcacctccgctgctggaactgcaattccaaaaggaagtaaaaaggaaaatagtgtgttcccacctacctccccaaccgcagatctctcagaggctgagctgggtgtgagagagtaaaacactgagccgagcacacagagaggggctgggggtggatgctcacaatgccggggacctatgaagaaatcagctagccctgcctccttccttctcttcatttgtttcaacaggtgctacatgcatcctaaaggtacctcctgaacccactctgacccccagatgcaaatgatacagtaagccccaggcttcccccaccatgtctcccctacacgttcttacactggaccagcaggacacgacccacaaccctcccaccccacctcctgggctctggatgcacaaagaacttctaattgcatttctgcgggaacccatcactatcaactccaagagttcaaaggcagcgtttcagagtacccctctctgtaaagaagagatcgcaggacactaggaatgttctggttctccgtcaggcagctcacgccactattctccccgcaaatgagggaaagacttctccctgctacccacacagcaacgtgaaatgccatcacatcacgtcttgggactggctcagttctcaggcatgaagagctgcactccggcagaaagggtcgcacagactccgaagaagtttagcagctcagaaagcatcacgctgtgtactaaggcagtcttcagtgaggacttccaaagtgacaaatgatagaaatatgcattcagtcttcaggatcctgaaaccatccccctggtgtctaatatcctttaacggctaggcaaatccttgcagacaagtagtgtgatgaagaaacagacagacacacaacacattggctatgccctaaggcagaactcacgcccctggagaactgagaccttggctctgaaatggggactccggcctcctgccccatgtgctcctgctcctagctcagtaggctgggcaaggcagcccagagaaggtgggaaaggtatccctggagaagttagggacagggtaggaagacaagtcagttccccacccagccacccagatggccccagatctgcggaaaaaacagtttcagagccctgactgttcacacccacgaagggcaaagtaatcccataggagtggaagccctgacggtgtggtcggacacacagctggtgacctgaaccggccgcaacaagacagaaagacagagacaaccagctaggagaaggagccatgccctgaaactggagatggggaggagataaagtcacagagggcatgggagacggcaaggttagagacagagaaggtgaagacggaaggctcaaacatccagagaagagaaacagaagacccaaagtaagaccagacaccccggactgagtattgattcaggggcatggtcggggacttgggacgcccagctcagccctcatcgcaggccaggacgaacagagggctcaactgtctgcacccagctcggcaaaaaccagagagatgctgctgcgacaaccgcccaggaacagcggctgaggatccggggagatccactcactcaggcagggagcgagtcaccaagacctacacgcacggagcaagtcacctggggtccccagcaagagtgatggggaacaggaacccagccaggctccggtaacccccaaagcgcccccgctggagaaaacttcccccagaccccaaggggtccgtgctcagactctgaaaggggcagcccacgacccctgagccttggcagggaccccacccggcttcccggggcaagaggcgatgtggagtcggtaggcttgcagagtcccagtctgatgaccgagttcaagggctaggggggcgtggggtcgggctgccttcctccctccctcgccgcggggcgcgagccgaaagggcatcttaccagagcccgggcgggcagtgccccccggctggccggctgctgtccccgcggttctccggggccgcctccccgcgcccgcgcctggggcccccgtcctcctcctcctccgccgccgcctcctcctcctcctcgggctgcagccggctcggcgggcaggtcccggcgctcccggcgcggggccggggccgggggcggctgctccccgccgccgaccgctgcgcccccgcggcgctccccggccccggagtcgaggctgctgaaattccacacgaccagcgtctgcagcagcagcaccgtgagcgccgcgagcagcgccgagtgcgagcgccgggccagcctccgggcgcacggcgccgccaccatcttcggagcgcggccggcgagcgaggcgcggggaccccggcacgctccgggccgcccccgcgctccccgcagctcccgcggccgccggctgccgctcgggctcccgctcgggccgccgccgccgcccccctccccacacccctgtccccgctggaggggagggtgatggggaaggcgccggggggacgcgggccgaggcggagagggcggggcctgggggaggagccgagggaggaaaaggaggagggaaaggaagggggtgggggcgatcagagaagacagacacccctcaggacgtagtgggagtaggatggggggcgagggggacaattcccaaggcggaaaaagagaggcaggggccgcgaaacaggggacctttggttgagggtgggcccgctcagaatccaggggaggtcaggaagagagggggtcccgaggtcctgttttccctgtgggccgctggaaggaggcagtgcgtggaggaagctcctagccccggagttcgcggtccagggatcttctgtcggtaccagaccggttggcaggtggacacgtgagaaacatttcaggagtgtcagagccacagtctgatcccttcatcctgggcttgaaggggtggggaggaggctttgggtgagtttctggagttaatcagcacaagctctgtgagtgactcctgaatcacacacaatccccggtgccaacgatgtactaagtgttcactgagtcacttctctggtccctgaggactcacaagccaagagactccaaacccagttggcaagtggtatagcggcaaaagggagacccgtggagttactcaaccttcgcaggatgcaagccccaaaggctggccccgcagcctcccagcgtgtccttttccccatccatcctgaagtcccccttcctgtctgcacagggcccaggtcctggggaaacaggtcttgctcttgaaagtggagttctttcccatcctgactggtctgtcccggtgaccttgagccaggaggaggaggactcctccctgagcccaagctttctcctctgtcgtttaggcagaatgatcccaatggactcaaatttcatcccgagccttctctgactcagtctttctggtttttccctcccttgtcctcttgcccagggctttatacacagcagcgcagaacagtgagcatatgggatggcgttggtgtcccatacgggacctagcactctgggaatacaacagcagatcaaatcagtttgtgaattgaggacttggcgtgaatgcttcgcatcttgtctgctgtgctttttcacctcatcctaatttacaaagagaagaaagtggagtgtaatgaaggctcatcagacaatgaggcagggagtgggaagagattgtttcatccactccacaagcatccgtgaatacaaagcttgtgtcagacactgggccaggtgcacgcatccaaaggtgaatgaggtttaatctcatcttcagcaagcctgaggtctagagaagcctgatgtggatgttaatcattaaaatatagtgagataggcctgggcgcggtggctcatgcctgtaatcgcagcactttgggaggccaagacaggaggatcacctgaggtcagaagttcgagatcagccttgccaacatggtgaaaccccgtctctactaaaaatacaaaaattagccgggcatggtggcacacacccctgatcccagctactcaggaggctgaggcaggagaatctcttgaacccaggaggcagaggctgcagtgagccgagatcacaccactgcactccagcctgggttacagagcaagactccatctaaaaaacgtatatataaatatatatatattgtatatatatatattatatataatgtatataataaatatattatatataatatatttatatatatgtacatataatatatataatatataatatataacatatatataatatatatatttatatgtaaatatatataatattatatatatatatatggtgagataagcattgctgtagagatgtgcaaaaatgctaagggttcatgagggcaggacgggagtaagcgccaagaaaaaatgctttctgaacccatgtaattagccagtccacttgcctgaacaagaaaagtataaaatgtatgctagtgggggttgtaaactccaaaccaatcaaccttagttgtatctaaagcttagccaggcatgtagcctggcatagaggccttccctttgggcccagcacccctaaccaggagtaaaagaccagaggcaagtttctagggccaccagtcatctgtttatcagttggggatattttgtttacaagcaataacatctattactaacagtaataagacttaagtctatcttttaagtcttttttttttttttttttttgacacagtctcactccatcacccagcctggagtgcagtggtgtgatctcagctcactccaacctctgcctcttgggttcaagtaattctcatgcctcagcctcccgagtagctgggattacaggcatgtgccaccacgcccagctaattttttttttagtacagacgaggtttcaccatgttggccaggctgatctcaaactcctgacctcaggtgatctgcctgcctcagcctcccaaagtgctgggattacaggcatcagccactgtgcccagcccggtctgtcttaaaaatatactttactggatcatgtagctgaacattgcagaggaaaggcttcaggtgaggtttgatctagcaactcacaattatcacctgggattccttttctttccatctctcctctctgctttccatggagtctaccttattccctcttgatgtcacacgatgcctggcctcagctgctgcgactactttgtatcctgtgttcatttctagcccagggaaaggagggtcagtatttcccaggattttcctcaaaggttcggagattttttttctgattagaccagtcttaagttctgggtcactccgagaccaatcagtgtggccaggaagttagaaaatgccgatcaacttggccaagatcccatatttcacctccgccattggggtgaagccagcctccctgtaacaacttggatgccctatagagatcagggtctgatgggaaagaagtaggtgcagggaacagattccatcatttattccacgcagcctcccgaggttatatgaccttggccaagccacctcccctcccaggacttagatttctttagtgccaaatgaggggttggaggagacagcccccaagatttcacatgttgccagaacgctctcttagtgtctcagcagagcttctcaacccagcagaggctgctctggagcctcttggcaaccctgccctctggctcatctttgcttcaaggtctctggccgcatttttcccgttagcagcaatgatgttatctgcttcctccacatctcacatttaaccacagtcctttggggcccaccctctggctccactccctcaggggccaggggcttaaggagtgaggttaaggatctgggctccaagtccctggagagagagttgtttgtttatctcagacttataaaaagccatgcaagaaagaggtttaaaggctccaggcgggttatggacgccataaacagcttatgtgatggttttaggatgaaaaatcacccgagatcgaagaataggaaggcaagcttctggggtcactggagctgtcttcctgcacctcaagaatctttgggtaaggaggtgagacaaagatgagatcagaacagcgggtggcttggagtgggagaagggcgtgaattttgacgaatctgcagtgcacatgtatctcagtaccagggggcgcagttggtttgggcagtgccagaacccctgggagcaggggccgggcatcatgtcttctaagccaaaccaagcaaaagcagccactttgcattcgaaggggccccggctttggcttccactgtggtgtaaaagcgagacaggcagagcttgatgtataagacagagccgaaagcaccgcctgagactccagcggcagccctagcaacagcagtgagagtccttagaatttttaaagctcattcagtcattcaacaaagatgtattggaccctattatgtgccggacgtcatgctgggaaagcaaactataggcgtgtagaagatttcctaaggaactctgctcttaaaatatcgttcctaatctcacttgaccaagagccagagctctgaagaagccccagactgatctgtgggattccctccccacctccaccccaaatcttgtttcatcgccattttccagtgaaggggggagtaaatcagttaatcagtagttttcagctcctaggtgtgcccagcactgagctcggggctgtgagagaaagtggaaggccagggggaaagggttcttctctctcaaggagctgtcagaagaggtcatgggacaagacaggcgcgggatggggtcagaggagggggcagccacagcggagtcagtgtgcaaaatggttaagagtcagatttcccaggtttactcagctctgctactttttgactcggatttctaagtatcagttgtttacctcgaggcctcagttttctcatctgtaaaatgaggctgataaaagggccattctcataagtttcttataaggattcaatgagataatccataagaaaggctttttcctatagtgactgacacatagtaagtgctccgtaaatgttagatgatatgtgtcttatttatttttcttcatttatttgagacaggttctcactctgttgatcagactggagtgcaggggcacaatcatggctcactgcagcctcaaactcccaggctcaagcaattgtttggcctcagcctctcaagtagctgggactacaggtgcacgtcaccacacccactaattttttattattaatttttattttatttattaatttttatttattttgttattagtttttattagtaacagtagggcactgccaattatgagtgtccaaaggtatccagggctgcctggagaaagtagcactaaaacctcatcctcgactttgatagaagattgcacatacccccaagggttaggaccaagtctcattcatctctactttttctggtgctttgcacagtgcagggcactgaatacattttgggggtggaatgaacactgatctatggggcaggtaggaatgagcctgggatgctggcaggttggaaccccatgcttagaagttcaaggaacccaagttcaaacaccatctcggcaacttgttagttgtgtgatgttaagcaggttagttaatgtcaccaaacctcgatactctcaactgtaagtagtgaagaaaaataatacgtatgttttaaggctggggggttggaggcagggaaatggggcagtgtatatagcagagtgtcatacagtttatacaaaatgatagcaccggccaatagcagtgttgaaggaatattagcctggttgcattggcagggtggtctgtaaagcaatgttctccccttgcctcaatgctcctgccccaggtgccagagagctagggctggatatgccttctgcatttaaataaacttcagcctaagagttaaatttagccaaatacattcttttttaaaatttcgatcatgcatttatttctttttggtttattagagcctgttttcacccagactctacaaattttgctcttgaaaaattaaaaaattccccctacgtttcacttctgcgttgagacagaaatcatgaacaggtgggtcacctgtttctgagtgtcagtgagtggtacgctgaacaccctcccagcccactaggaatcccagagtctctccaataagcatttgcaagtgcaaggattccacgtggaggtcagaggagccaggaccttgaacgtccctggagccccacccacagcatgcgaggtcacagacagacaggcatcacctgtacctctttccccagtgcaagagaaagaaacagcctctgatcagaccacaggcataggcaggtgacaaaccccgccaggagcccagctgtgcttctgctgaaatccgcaggcttccaggctaatcatctacccaatgcatcagcagagggagctctaggtagtaaataacattcctctgactgcagagtttcctgtaaaaaaaatctggagacagcaaaggaaagcgaggtcctatgtggagagggcacctaccatgtgtgcagaagaaaatcacaccaatttgcaagagtagggtgttggggcaggagtgggagatgggaaagagagaagaaaatcagaaagcaccacattgcttaagagatgatctgaatttgttttgtctcagcactttgaccttctaaggactcacagcctctatgctacccttgcaaggctctgatgtttgaaaaggggacgcagtccaagtctcagactacactggcagacattttttttctttaaatgttgattgtgggctgggcgtggtggctcatgccttgtaatttcagcagtttgggaggccgaggcaggtggatcgcttgaggccaggagtttgagaccagcctggccaacatgacgaaaccccatctctactaaaatgacaaaaattagccggggatgatggtgcatgcctgtagtcccagatacttggaaggtggtggtcacaatgagccaagattgtgccactgcactccagcctgggcgacaaagcaagactccatcttaaaaaaaaaaaaaaaaaaaaagttgattatatgtgttatgggtgcctaatctaacccctggggccataggcttatttatgactgtggcaatgacaaggatgacaatgatgacgatgacggcaataagagcgaacatttattgagcacttactaggtgccaagccgtatattgaggacttcaacaaatcatattcaccaaatatttgttgagaattgattcaatacttaggacagtgttcatgccagggattcatgggaattcatccacggataagacacagaaagtccctcctgtcatcaagcttgcattctaaggaggcagacaggtcaagacaaacaaatatataaacaagtaatatcagagagtgataagtgctatgaaaaaaataaaaagaggctgagcatggtggctcacgcctataatcccagcactttgggaggctgaggcgaggcgggaggattgcttgagtccaggactttgagaccagcttgggcaacatagccagacctcttttctacaaagaaaaataatttaaaaattagggttggtagtgctcacctgtagtcctagctacttgattctttgtgcccagaagttcaagactacagtgagctagattgcaccactgcactccagcctgggtgtcagataaagaccctgtctcaaaaaaaaaaaaaaaaaaaaaaaaagaaagaaagaaaaagaaaaggaagctgacttgctagagtgactaaaataggacaaggggaaacaggctggtcagggcagaccttacccagacaatgacactggagtgttgataaccttctcaagaaatgtgactgtttaacaactcttactccatttatgcatcaagcatcatctactgactgaacaaataactgtagatccatttttcaaatgtgtgatatataaatgatgctaaattcattgtcattctttgggcattttggattttcttaaagtgattagtaataactatttgcatggtcatgatgggagctatggaatgggttaggaaaaagttcaccaaaaaagaaaagagttaaaaatatccatctcaccaaagaagaattgagagcaactaatgtattagatctcaaatatttttggtccaaatacttttttaatttcttaactttaccctcctcacccctctcaaaggttctgtatgccacagatgtttctatttagcccctgtatctttaagtcggcaggctgagccccgtagtccccaaatcacctctcccatcttgtttgtagcttcttctctgcaccccaatgtcaacccatcctgcacctattgctatttctctctgtgtctctcaaatctcttttacctgaacccctaagaattctattccacaagggctaagtgtacggtgttgggggcgggagtgggagatggggaggagggaagaaaatcagaaagcaccacattgcttaagagatgatctgactttgttttgtcccagcactttgaccttctgaggactcacagcctctgtgcttcccttacaaggctctccttgcacctgccctctaagaactctattccacaaggaaaacagaagttcactggaagcctgtttgatatgccagagtctgttagctgcttctcaaatacccattcttcctttcctgtttggtcaagaattctgattttagttggggtgacaatgagcccaaaccaaaagcaacggttcttagccttcctgtaagttaggagtgatcggaaagaagacagcagatacaattggtagagctcccaagaaatcctttggggtgggagggaagatcctaaataagttgggattgagttccctttgtgccttgccattcccattgttttttttctattcttaacttcagacagggtctcactctgtcaccccagctggagtgcagtggtgcaatctcggctcactgcagcctcgacctcccaagcccaagcaattctcctgcctcagccccccaagtagctgggacacaggcacctgataccacatctagtttttgtatttttagtagagatgggggtctcgccctgttgctcagtctgatctctaacttctgagctcaagcaatctgcccacctcaacttcccaaactgttaggattacaggcatgaaccatggtgcccagccatcattcccattcttttggactggaatgtagaaaggatagctggagctccagcagccatcttgtgaccatgaggacagaggccagtactacaggtggtgagccagaaagaaagaaacagcttgggttcctggtgctctgctgtctccggcccatccttagacttttcttcacacccaagaatgagccccatattagttggagccactcaggctgggtttctgtctctatagctggtacgatgacgtgtctgatagaatgaaacagtctaactgaaagaagctcagggatagaggtgggatttgggaagagctggaaccagggacccaaacacagaagtcacccgctttatctcttgctctgcttccttctgcctgcttgattaattctccctcctggcagaacaatgctgtccacatggtaagaagcataactgccacagctcctgagtgccacactgtacagcctccataaagggacaggttctccctctaaggccatgagccgcaagcgggtcctcaatgctgtctcattcgctgcattttgctggtcttgtcactctcccaggcatgaagccaccagctctctctcccctcctgcctctgactttcctccttccccacttgcctgaggaccttgcttcccaggttgacaagggagggggaaggaagcttcccaccaagctcctgccatttaatttccccacttttctacatcggtgtcgcggactgtttttgtgaatgaactttctaggctccaggtcgagacccactcctccatctgccaaagagaccccaccttgtcttacctatctgcggacatcactccaacacttccattttctccttcctttatcatcagttcttcctcccgagagcagcatttcctctagcatttgaattccctggtatttctctggttaaaaacaaaagttctgaccaggcgtggtggctcatgcctgtaatcacgcactttgggaggctgaggcgggcggatcacctgaggtcaggaatttgacaccagcctgatcaacgtggtgaaaccctgtctctactaaaaatacaaaattagctgggcatggtggcacatgcctgtaatcccagctacttgggaggctgaggcaggagaactgcttgaacctaggaggcggaggttgcggtgagctgagattcggctgagctgagattgcaccattgcactccagcctgggcaacaaaagcgaaactccatctcaaaaaccataaaataaaaaatgttctctcctggccccacagccctctatagcttcgatctcgtgtttctctttcttttgcaggaaaactcctcaaaagcattgtctagctcaccgtatctccaattcttccctttccatcttctcctaagcccttctaacacacacacacacacacacacacacacacacacacacacacacgctactcttaagctcatcagtgacctcattaccagattcaatagttacttagcctaatgcaacaaaggtcacagttgtcccttccttcctccttatttatttctttggcttccaggatgctgctctctgggttcgctcctatctcacagctgttccttctcagcctctttggttaatcccttctcttccagctgtcctctccccttccttaccccaattttctgtgctggcttttcccaggctttaattccatagcttttcttctccaccatccagatgcatggctataaagaaatcctctaattcacatgtttatatttccagcctgtactcctccccaaactccaagttcatgcactcagttgctcacccagcatcgccacttggatgtctaatagacatctctgtcaagaactgaaaaaggggctggggatttgaccctacttgcaaactaacaaggtattctgccatagcttcatgaattccagcagaagacatgagactcctggatcagagacaaaagatcctattacccacctcatagcaggcagcatgagcttcatgtttgcatcagttccctccctgcatcccccaccaagtctctggggtggtacagagggggtcaaggcagatgctctacacatgactgagaaacctggagttttgaaaaactctgtattttataatgagctgcaagcaaatctgctcaacctttgccccagagggagacattatctttattagcctgaatagcaaacaaatctgccctctgcccagaagggagacactatctctgcctactaaggctgttcacaatacaaatatgaagtttatatgccttttgatgtcttgaaaaggtcatccggaggccaggcatggtggctcatgcctgtaatgccagcactttaggaggccaaggcaggccgatcacttgagcccaggagttcaacatcagcctaagcaacatggagaaaccccatctctacaataaatacaaaaattagctgtggccagacatggtggctcacacctgtaatcccagcactttgggaggccgaggtggatggatcacctgaggccaagagttcaagaccagcctggtcaacatggcaaaaccccgtctctagaaaaaaatacaaaaaaagtagtcaggcttggtggcggatgcctgtaatcccagctacctgggaagctgaggcaggagaatcacctgaacccaggagttggaggttgtagtgagccgagattgccccactgcactccagcctgggcaacagagagagactccatctcaaaaaaaaaaaaaaaaaaaaattaactggaagtggtggctgtgcccgtagtcctaaatactcaggaggctgaggtgagaggatggcttgagcccggaaggcggaggttacagtgagccaagattgcaccactgcattccagccaaggtgacagagtcagaccctgtctccaaaaaaaaaaaaaaaaaaaaaagtcatccagaatagaaagccacaatgtgcagaaatataaacagcccatggagaattatttcctaacagtattaaacttatcatatccaaaatggaattcttgaacttccttcccagctcatgccaccaaaagcttttccatatcaagagctttcagtcatcacagctcctgtcttttgctcgtaatacgcacccaattcatcagcaaatcctgttggcttcatgttcaaaatatttcccaaatcagattacatctcactgtccccatggccatcacttaggtccaagccacattgtctctcccttgattccgcagtcacctcctaattcacagccctgcctccaaccttgctctgttctctccacagcagccagagaaaacctgattaaacttagctgcagtgttgtcattcattagttaacagcaacatcaaggggatcctcatttctcttagaaataaagccagtgttcctataagagcctgcatggcccccaccatccagcccccagcatctctctcacctgcacaagctattttcctgccctttcctcacacccttccatcaccctggtttcctttcagtttcttaaatacgccaggcaggtgctcacctggcggcattgccctggtttttcattatgtctggaatgctgtgcacccagatatctgcctgtctccctcccttaccttgtctccctgcctttttcaagcttctgaagaaggtgtcatcttctagttacagtagttagctagtcagacatgaacagggcaggagagggctcctcccccaccactaggaatgtcaggcaaccatggtcaggcagctgttaactgtctctctaaaataataattggttgcagtcagcaccagggaaaggcagtttcccaatgaacagaaatacctgaaactggtgatcagcagcttcccgataagatctcaagagttgggcaagtaggttcaagcatgcacactaagaggcaaaatggcagagtttaactggtatatgacctcctggggacatctgactggtaagggaagaacgctttaactgagcatgcgtacaactccaggaagcacactcagcatgcttctctccaggccactgctccaggtaacatcctgccccaagggaagaatcaggggagaagggacgcaagaccccagaagcatgccagtgtatgaccccaagtcaaaggtcaaacagcgcactttatctctcaagtcgcctgcttggtcctcttccaagtataccattttttgtttcattcctgctctaacgcttttttttttttttttttgagttggagtctcgctctgttgtcgcccaggctggagtgcagtggcttgatcttggctcactgcaaccttcccttcctgggttctaagtgattctcctgcttcagcctcccaagtagctagaattacaggcatgcaccaccacactcagctaattttgtatttttagtagagacggggtttcaccatgttggccaggctggtctcaaactcctgacctcaggtgatccacctgctttggcctcccaaagtgcggggattacaggcgtgagacaccacgcccagccattcctgctctaacaccttttttttttttttttttttggagactgagtctctctgtcaccaggttggagtgcagtggcatgatctcagctcactgcaacctctgcctcccaggttcaagcgattctcctgtctcagcctcccgagtagctaaaattacaggcacccgccactacgcccagctaatattttgtatttttagtagagatggcgtttcaccatgttggccaggctggtctcaaactcctgacctcatgatttgcccgcctcagcctcccaaagtgctatgattacaggcatgagccaccgtacccggcctctaacactttttaataaactttcactgctgctctgaaacttgcctcagtctctccttctgccttatgcccctcagttgaatcctttcttccgtggaggcaagaattgaggttgctgcagacccgtatgaattcatcgccagtaacattctcatttaagcctttcccaactatcgcagtggaatcacagtgcctcagccagcacccccaattgccttgactttgttttattggtctccgagcactgaccaccttgttcacttattctatttattgttgtctgtctgtctgaccccattagattataaagcccatgagggcaaggttttgtctgctttgcttactgcttagtgcttggcacatggtaagagcttgattaatgtttgttgatgaattgaagttgaagtcagagtccaaagacattgcagaaaacagcattgattatcctgcctcacctggggcgcaatgactggagttacaggaaaggggtcacataagaagacagagaaggatccggtgtggtggctcacgcctgtaatcccagcacaacaggaggctgaggtggaagtatggcttgagcccaggggttcaagaccagcctgggcaacatagaaagaccctgtctctacaaaaaatttttatttttttatttttttaaaaactttaagtcctgggatacatgtgctgaacatgcaggtttgttacataggtatacatgtgccatggtggtttgatgtacctatcaacgcagcatctaggtttcaagccccgcatgcattatgtatttgtcctaatgctctgcctcccctttccctccaccccccgataagcccgggtgtgtgatgttcccctccctgtgtccatgtgttctcgttgttcaactcccacttatgagtgataacatgtggtgcttggttttctgttcctacattagtttgctgaggatgatggtttccaacttcattcatgtccctgcaaagaacgtgaactcattctagctgggtgtggtggctgtgcacctgcaatcctgctactccaggaggctaaagtgggaggactgcttgagcctgggaggtcgaggctgcagtgagacatgatcatgccactgaactccagcctgggcaacagagggtctctaaaacaaaaaacaaaaaacaaaacaaaacaaaaaaagcaaaaaagaggaagaagaagaaatgagaacctatgttaaccatgtaatgaaaaagccactggcaagaaggggagacaccaactgtgctgttgatgtcggaggcagggcaacagtgggggaacaagaccctggacccaaaccacttgggtttgaatctcccatgtacttcttactaactctggtgtgttggagagattgtttcattttctcctttctttttcatctgcaaaactgggggaacacggtactctcctcctgcgattgtcagggggcttaaatatatgaattaatgttaaaaagcactcgaagtagcactcagcacatagtaacatcaaatacaagatctgaaaactgttagaaaaacaatgagaacttgataaaagaaatacatatatatttgaagaaatcaatatgcttcttttccatagcaggtagataaatagaaagaaaaatcagtaaggacatagagaaattgcacactgcaacctacaaactcaatttaatagatacatagagaaacacttaccttaacagaaagtaaatattatcttctaatatccacggaatctgtcatatacctaaacataaagtaaacctcaacaaataaaataaaaaagatttttctcaagccagattctccctaatcataatccaatattataaatattttattttatttgttttaataacttaaaaagtgagaaacaccaccctagataatggaatttaatcttttttagaagagcaataaataagagaatatcacaaaatcaacagaatacaacaaaagctatagtcagaggaaaattaatagactgcaaaaccttcattataaagaatgactaataagacaatgaagaaatgtatgagcccagaggttacaataagaaaataaaagaaattctccataaaaaataataatgacagaaactgaatgtaatgaaatggaaagcacaaacaacagcagaaagtaaaaaatcaactcaaaaactcattttttgaaacaccagattaaacccctggcaagtctgatttagaaaaaaaataaataaataaaaataaaagtatagctatgtaaaaaagaaaacttagccaaaatcacagaagtaaaggaaaattgaagagaatatcacgtgcaattctatgccaatacatttgataacctggattaagtggctaatttcttgggaaaaaaataaacattaaaaatggcccaagacaaggcagaaaacttggagaaaccgatgaccagaaagagatggaaaatttaccagatcagagaggttcaaagctgagttgtatataaccttatgtgtaataaaaaggattgctccaatgttacttattccaagttgtacacagttgttctcagacttgactgcatggtggagtcacccagtgagatttttaaaactaatgatgtccaaatcccaccccaagaaatatctattcaactggtgtgggctgtgccagctatcagcatcttgaaacagttctccaggtgatacaaatgtgcaagccaaatgttaaatcaagtgtagcctaaagctgtcttcttatgtattcaagtttggcctaaaggtttttctgtatctgctgaactatagcaagtggaggtgtaaacagaccatagcctccgcttgtgacaatcactgagttttggccaatcaaatgtagccaactgtttgaaccatgttcaaataaggcaaacacgagctgtaaccaatccagctgtttctgtacctcacttccatcttctgtacatcacttgtctttttctgtccacaaaccttcttccatcccctggctgtgctggagtctctgagcctaccctggctgggaaggctgcccaattcaccagtcgttcatggatcaattaaactcctttaaatttaatttgcctgaagtttttcctttatcacaaggttgctagcccctgccatagaaaggaatgcagagcttttcaattaaaaaacaaaaacaaaaaacaaaacaaaaaaacccctcagttctggtaaagatagcaccaggaaagaaaactataagttaactttacttatgaaaaaaaatgaatcttttgaataaactaccagcatcaaaggaataatgtgttatgaccaagcagtttattccaggaatttaagtctgggttgaatcaggtaaggtatcaacataatccaccagttccattactctgttaaagatgaagctgagaaaccatttgattacacttgggagtcattcttaagaaatcaccaagtaaaccattaatagaaggaaattaagtataatgcaggctaacgaacaaaaaattactcaaaatggcaaaaattaaatcttaatgcatttaaaagttcttgtaaatgcattaagataagaaaacaaaataatctgtaagtattgcaaaagaaaaactaaaactctctttttgctgttggtttgcttgtatactatattagagttctacatagataccaaaccaataggatataaatatagatagatatggatacagatatatgagatggggctttattagcggcattagctccgatgataatggaggctaagtctcaggacaggctgtctgtaggccggaaagcctaggatgccagtagcctggctccattcaagtccaaagcctcagtgtcagaaaagccagtggtgtaactcagtccaaggtcaaaggcctgaaatgaaaggggcattgagtaagtcatgaagtcccaaggccagacaccctggagttctgatgttgaagggcaggaggaaagtggcccacctccatgagagagagagaggagaggaggtatattagtctgttctcatgctgctaataatgacatacctgagactgagtaatttataaaggaaagaaaggaaaggggtttaatggattcacagttccacatggccggggaggcctcactatcatggtgaaggcaaggaagggcaaatcacgtcttacacagcagcaggcaagaaagagcttgtgcaggggaactccaatttataaaagcatcatatttcatggacttattcactaccatgagaacagtatgggggacaccacccccatgattcaattatctccacctggccccacccttgacacatctggattattacaattctaggtgagatttggttggggacacagccaaaccatatcagaaggagaggaggagagtgttaccttctccaggagagactgtccgtttctccaataaaaggagaggaaattctttcctttctcatattttgttccacctgtgctccccactgattggatggtgcctgcacacttggagggtagatcctccccaatgaatctactgactcacatgccagcctcctctggaagcaccttcatagacattccaaaagcaatgctttatcagttctctaggccttccttaatccattcaagggtaacctaaaatttatcatgacatatactaaagaaacctaatagactctagtaaaaaacaaacgaacaaacaaaaaccctactacaatcaataagaatttgtaaaggaactggaaacagtagaattatacaaatattaataacctttctctataccagcagtaagaaccttgaaatagatatggcaggaaattagatggaaaaatattctagttacaatagcatgaactataaaataacttgggaccacttaagaaaaaagacttgggaattataggaaaactatttgtaaagtaatgcccaaaaatctcattgaatttcataaaacacgatccacacaaacgaaaataaatgctaagtcttgcatgggcaagttgatataaaatataaatcttacaaaaatcaataaaattaacttcaagttccaatatcaataaaatatcaacagcttgcttttaatggtgggtggaggggaaaagggagattggattaaacgaatggaggaaggaatacacttgaatgaccaaatggaaataaatacaaacatacactcatatatgtatacaaggcagacatatacttgccttaacatatatcagaatataccataaagtcaactataaacaaataaatatgctgctagtttagaaataaatagatcaatataacagaactcaaagacaatatttgaatctggtagggaaatatggtttatttgaagtatgttgctagcccaactgattttccactggaagaaaataatgtcggactcctataatataccatatattaaaaaaacaaatccaggctgggcatggtggctcacgtctgtaatcccagcactttgggaggctgaggtgggtggatcgcctgaggtcaggagttccagaccatcctggacaccatgatgaaaccccgtctctactaaaaacacgacaaaattagctgggcatggtggtacatgcctgtaatcccagctacttgggaagctgaggcaagagaattgcttgaacccaggaggtggaggttgcggtgagctgagattgcaccactgcactccagcatgggcaatagagtgagactcggtctcaaaaaaaaaaaaaaatttaaaaacattaaaaaaaatttgtgttaatctagatggagtaaaatcttaatgtaaataaaacaacaatggggttttttattttaaaaaataaaaatatttggtttaatcaacaaatgaataaagaaaatgtggcatagacatagacacacacacacacacacacacacacacacacacacacacacacactccccagggaatactactctgtgataaaaaggaacaaaataaaggcatttgcagcaatctggatggaattggagaccattattctaagtgaagtaactcaagaatagaaaaccgaacgttatatgctctcactcttaagtgggagctaagctctgaggacgcaaaggcataagaatgatacattggattttggggactccagggaaatggtgggggcagagtgagggataaaagactacactttggggccaggcacattggctcatgcctgtaatcccagcactttggaaggctgacacgggcggatcacctgaggtcaggagttcaagacaagcctggccaacatggtgaaaccctgtctctactaaaaatacaaaaattagctgggcatggtggcatgtgcttgtaatcccagctactcgggaggctgaggcaggacaatttcttgaacccagaaggcagaggttgcagtgagctgagatcacaccattgcactccagcctgcatgacaagagcgagactttgtctcaaaaaaaaaaaaaaaaaaaaaaaaagaaaaagaaaaagactacacattgggtacagggtactctgctcaggtgatgggtgcaacaaaatctcagaaatcaccactagagaacttattcatgtaattgaaaaaaaacaatgaagaattcagaggtgatagaaaacaaaaagcagcacttttggaatatactatgaaaggaggtagtggaggttatgagaggcgtcagaaagaagacaattttgaacaacgtgagccctatcaactgaggaagcatgagaaagatgtgtagcatagtggacctgtgctaagatgtatagcatagtgtagtgtagcacagtggagactggactaccattcagcaaagtaaaggaatgaagtactgattcacaccactatgtggcaagtctttaaaacatcattatgctcaggagagaagccagacacaaaaggaccacatgctgtatgattttatttatatgaaatgtccggaaaaggcaaacctattgaggcagaaagtagattaatggttgccatgggtacgttgtttgttttgggggtgatggaaatgacctaaataaaattaggttgtggtaatggttgcataactctataaatacactaaagcaggtgagttttatggtatgtaaattatatctcaataaagccatgaaaatattaatgccactacagttacatttattaactatgcaaagcataggatgtcctattccaccaagagtatcaagtacagattttgtgtgtttgtgtgtgaatgggtacataccatttcaaataggtcaattgtcaaaaattgaaatgcgagatcagtaaactgccatcacctaaaacttcaaaggggcatgtgactagcttagcaaaggtacacatggcgatgaaacatgccagctctgggggcagaccacgctgggttcaaatctcagttccaaaacttactccttgtgtggcacatggcctcagtttccctatctgtaaaatggagagagggttgttgtgagaatgaagtgaagtgatgtgtgtcaataacagataatccttagaacagagtaggacctcaacaaaactgatggtggtagtggtggtggtagtgattaggattagagtagagaaaggatcagaggagtcttatgagatgtatttatttgtattcattattaccttttatttatatggatatatttgcatatatggacattttactttaaaattcacagtattatccatggtaagttgtcatgtaaaagttccaaaattgttagagagacagaaaattgctggctattgccaaagtcatttatatactgggaggaaaataggtgctatctttaaactttctcatcagtatacctaggatgcggcgggggaagaggactccattccatttgtggtgttggaatcgcaccgccccccacccacaacggttccttttacaggcagtggaaacagctctgaaaagcttgctttgggagggacacccagcatgctgagatgtcacagtggtgctcaaggaagctatcattcatactgctataatctaacacagtgatggggttctgggtcagataagacactgctaattttttaggccaaagaaagagatgtatttttctgtaggctgttatgtgtttgtttaaaaatcatgtcattccagcctgggcaacctaacaagacccagtctctccaaaaaaaaaaaaaaaaatagctgagctaacaagtacatctgttgccccatctgttcaggaggctgaggcaggaggattgctagagcctaggaggttgaggctgtagtgagccatgattgcaccactgtactccagcctgggcaacagaaagaaaccctgtctcaatcaatcaatcaataaaacatagaaagaactgtttgggggtactggaaatgatatataaccttggtttgggtggtggtacactggtgtatacatgtgtaaaaatcagctgagctctatacttaagttgcatatactttatatattttatatttcagaaacagagaaagatcagaatctaattcaaggaaacattcctgtacacacaaaaatagtcatcatatcttatatgcaaagatagtcatcatagcatctttgcaatagcaaaacatctgaaacaatctaactttcaacaatattgtctaatggttaagtaaattatggcatatccactaattagaatatttatataactaaaatgttcatgaagagtttgcaaaaacatggagaaatgccatgtcatcaagttaaacaaaaaaaatcaggagctaaactccttatatgtgatatgtaaacataattatattaaaatatgcataaaaatgatgacagaaatgccccaggctttaatactgaccatttttcagtggtgaaactatggaggattttcctttcttctttcaaattttctgcacttataataaataaatttggttttcataattgcataaacataactaatacttttaagtttacaatagcaaaaagcaaacattggaccaggaatcaatcttgcagtgattaacagcatgggatgcttgcagctgcagacttggtgtcagatgctggtctttttgctttaaaagggcagtcattactatggctaaaaccaatttcgtaaggagatcaccatcaggcttggcattacagctctgttgaagcctcctgacatacagttttgagatgcgcctcctggtcagaaaatagtcggctatgtcctaccaattaaggatttctccttcatcaccagaataagctcttcggataacttatacttccaagcagtttctgtgcagccagcactggataaaaatgctatcaccaatggagtttgaatctcccaagatgacaatatatccatatatagtcatcctcggtgtctgtgggggattggttccagccccctccctccaatactaaaatctacaggtgctcacaccccttatataaaatgccatagtatctgcatgtaacttaggtacatctgccagtatactttaaatcatctctagattacttatgatacttaatacaatattaatgctatgtaaatagttgttatactgtattttttcacttgcattattttttgttatattgttatatatttttcctgaatatttttgatttgtggttggttgaatctacggatgtagaacccaaggatagttctagagaaggctcctttgtacctaaatttggagcattccaagtatcctccaaagccttctactactaaaggaagatacacatttttgggaggaggaacttggaggaatttgggcttgatctttgaacaagattgtctgatgaagacacagatgatagcagcattaaatatcctcactgcatttatcctttagtcagccatttattaaatatttattgagaagcagagcttgcactaaactccattatttttaagcttacactaggggttggcaaataactttcatcctgtatgcctaatttgatgggttgatagtggtgctctcaaatgctctcctggaaaagattctgggacagggtccaaactcaagtgaaaagagcaatgatcgattagtaatgtctcccattcttgcagaaagggaaatggtggtatatatgctatgctggccggatatttttctgccaggttaatgactgtcacttaagccttgacacacactctctttccttacaagttaaaggaaccaaacttctatccaagttaacatcactggagaagcactaacagagggggaaatagagacatgtttgttagcaatctactacattctagaccttgcagagttctctttacatatactgagtcatgtcatttttaggatatcccttcaaggtaagcatccttatctcctttttacagataaggacctaggcgaagagaagcaaaataactttttgaagtctcacaatcagacacagcagaatcactcttccatccaatgagaaacccaggcttgatatggaaccaagtaagataagacagtgtccccttcttttcagaaggttataaaattaattctacaaatttttgataattacctgagttaaataggtccctttggagaagtattcaatccagtttgttcatcaagacaaaaggaggcacagtcatttccactttctcttattttttctttttttctgagacagagtcttgctctgtcgcccaggctggagtgcagtggcatgatctcggctcactgcaacctccgcctcccgggtttaagcaattctcctgcctcagcctctggagtagctgggattacaggtgtgtgccaccatgcctggctacttttttattttttatttttagtagagacgggatctcaccatgttggccaggttggtctcgaactcctgacctcgtgatctgcccgcctcagcttcccaaagtgctgggattacaggcgtgagccactgcgcccaacccattttcactttctgcccactcccatacaggcaagcactagtgtccttcaaagagggtggtactcatatcatccaagcagcaacatcagagcattttgatcctggatacaactgcacactctatggatgagctccagcaaattcaactgaccctgtttttcagtgtggttcaaatgtctgtgattatttggtggagcagtcatgatctcataaaattacatataattacaaatttactaagtgccaattcctctgctaagggctccagctgcactatggtgttgcatcctcacactatctctgtgacagaggtaacatcattatcctgattagacacatgaaaaatatgaaactttacagccaagaaacttagtcaaagtcacagagctagtaaggtagggctgaaacttcagcccaggccatcagacctcaaagtctatggcttaacttcaatttaaactgtttaatcaacttccagttctggctagtttccagtaggtcttccctagaggaaaggacacatatttcaggacaataatttcagtggaagttatatatttgagtagagatctcaggaagcaccagaagaggactggagagtgagacagggaagagaagggaatttatctcatcaagcaacttactctatgggaaactggagtccaatatttcttggagaactctgggtaacaatgtactaaatgtaaccccaaaacaagggagctgaagtatttatacaccctttcttagtagttattggttgagatctgctctcacagaacatgaattccttggcacttcaagtccgccacacatgtggagagagtggatgctggtggccagaaagtacccttaggcaaagaaccctaggactggaggccaaagccagtgagcctatgtagaaacatgagggcctaggaaatgtgggcagcaacaactgccaaagtctaccttcactttctttttaatttcaattttcaatttttgtttattttttgtaaacaggatcttgctcagttgcccaggcagaggtgtggtagtgcaatctcagctcacagtaacctcgacctcttgggatcaagcgatcctcccagctcagcctcccaagaagctgggactgcaggtgcatgctgccaagcccagctaatttttaaaattttttttatagagatgggatcgcactatgttgcccagccgggtatcacctcctgggttcaagtgatcttcccactcagcctcccaaagtgctgggattacaggcatgagccaccacacctggcgcttctctcttttaaataaacaacttgatgagttgatgggtgcagcaaaccaacatggcacatgtatacctatgtatcaaaactgcatgttgtgtacatgtatcctagaacttaaagtataattaaaaaaattgaattacttactttaaattggtgaatggtatggaatgtgaattatatctcaataaatgtgtcaaaaaaaaaaacaacttgactgaggtgcaaattatagatcataacatttaccaattttaagtgtataatttaacaactcttggcaaatttacagagttgtgtaaccatccaacatcatctatttttaggacattttcatcacccagtaggatcccacatacccatttacagttacttcacattttcactcccagccccaggaaaccactaatctactttgtctctatggttttgccttttctggacattttatataaatggaatcatacaatatgtggtcttctgtgtaaataagaaagtccctctccaaatggataacactgtagaaatgaaaaaaaaaaaaaaaggagggggataggcaagtaacttctagcaagagacttctccatatgggaggtgggaatgttctagatgaaacaaacaatgactataacgcaactggcaatgaagagacaccccctgatcactgtggaatctcatcttccccaggatgcatttgcatatacaagcttttgagtgaatgtattttgaaggaatcttttgcatacaaaggactagcaggcagcaagctgtgggttaagaggctttgaagcccattaaaccatcaacctcaacatggaaatgaatgggatcaaatagtttctgatggtttcaggagctgaaaagggtcagtctttgggagtgactgatgtacaaagggatctcggtttcttctcaggcttgccaatccctttatactttccccaaaccttgtacatgttaatgaaattgacacaacattaatggaaggcaactagagcagaagagctggtcaacggtcaaccaccttgtgtctccaggacagccatcttccaggaaactgaagcctcctgtcacacagactttgtgtctgttggataaagtggttaaaattccccatgcacaaggcataattggctcatgactaaccgtctgcagaaacaaccactgataaatgcaaataagatgtgggatgtgggatgtggtccacatcatctcacacaaaacagacttcagcctcctgctgaaggtcaatttctccaagctgtttctgctccttgattctggaccaacccatagagtagaattttgactattgtccctctggggatccctgtcacgtgctactcaggagcacccattttttttttcttttgcattgtgaacaaatcgaggaataagcataacaacaaatgactggccaaaataccagctttattgttggtaatgccaggccagaaggtaaggcttatacccacaaccacagtgtgtttccctgatacatacccctgagcctggatcctcaaatccgttaaagggaaacagcagaagagcagctgcaaaggagctagtctgggccccaggagtagagacagaaagaagtgcacgtctgctcctctctctacaaggccagcaccaagccctgacccaggcatgctgatgccacgtatgacaccctcatccagggacaagcccagagctccaaaagaaagtccaagggactgatgccctccaccctgagatttcatctttccaatcttttcttatcagatacgtgatttctccactcttgtagaaaagacagggacaaggtgaagggaaggatagaagcttccttttgaataattccaggaggtagagggtgtggtgatgaaaaatttatattctttggactaataaaaatattagattagaaaacaagggccaggagtagtggctcatgactgtaatcccagcactttgggaggcagaggcgggtagatcccttgagcccaggagtccaagaccagcctgggcaatatggcgtgacccccatctctataaaaaataaaaaaattagccaggtgtggtggcatgcacctgtggtcccagctgctcagcaggctgaggcaggagaactgattgagcctgggcagtcaaggccatgatcacaccactgcactccagcctgggtgacagaacaagactctgtctcaaaaaaagaaaaaaataggctgaggtgggcagagcacttgagctcagtagttcgagaccagccggggcaacatggtaaaaccctatctctacacaaaatacaaaaattagctgggtgggatggcatgtgcctataatcccaactactcaggagcctgaggtaggaggatggcttgaccccaggatgttgaggctgcagtgaaccttgattgtgtcactgcactccagcctaggggacagaccaagaccctgcctccaaaaaaaagaaaagaaagaaaaaaaagaaaaatttgcctgtaagagaaaaaataactttctctcttatctctgtctccctgccgatacacacatgtgcacatgcatgcacatatgcacaaacacacacacgaggagttgaagaacttggattcttgccctgcaaagtattctttcagccctactttcccatgatttcagaatctataagagccttatcttagaatctaccagctgcagagtatgctgtttgtagatgccctgtctatctctgctggtgcttccagtaaatgtgtagccaggacttgcccactcaagcctccagggttccagcaggtaaccaaagctaatggaaggggccagctataggagaaaaggcagcactggggactttggtgacctggagagcacaggctgccccactccagcttattactgtcctgcgggaatgcaggctcactgttgcccaatctctctgagtctcaagagaaggaagccattagcatttatttttgtgtgcaaaatccttagctgtttaacagctggctctgtttttaaaaacattgcttgtttgggccaaatgaaatgcatctgccaactccatttaacccatggtcagctgcttgtgattctggtgtagaatggccacatgggcaatgacatccatccttctgacatcctgggccagccatggaaggaaaagtagaaatttgctgtgagggcattggttaggattagtagtccccagggatgctcactattgcctgtggtagtgtctcaaactccaccattagaagtgtattccctcaaggccgggctcaatggctcctgcctgtaatacccagcaccttgggaggctgaggcaggcggatcacctgaggtcaggagtttgagaccagcctggccaacatggcgaaaccctgtctctcctaaaaaatacaaaaaattagccaggcatggtggcgggcacctgcagtcccagctacttgggagactgaggcagaggaatagcttgaacccaggagatggaagttacagtgagctgagattgtgccattgcactctagcctgggcaacagagcgagactgcccccccaaaaaaaaaagtttattccctcgaatcctcagggattatctatgtccaaagtccccagaggactgcaagtgtccctgagtcatgtcccacactttgggaggcagaggcaggtgaatcccttgagcccagaggtccagtccacttccagaggactgcacacataaaactgtgacatcagcttctgggggctgttcttgtggtcatcccgtgcccaccttggagactgtaacagcatccccctaccctcaacactcagactcacccttaaaagcattgataaatggcagattttagtacagttttcttgagagatggagcagaggctgacagggtcctgtggacataaaacttcctcctaatcccctctgaatattccccatttagaatgccacatgcaggatttaaaaaaaagtctcccttctttttccttcttagggaaaatgctccctctgaccaataccttccaagaaataaaaacacaagtaaaatccccccagccagtggcttctccagccaaattggtcccgtcaaccttcatataccttcaggaaagcaaacatctgctaatttcatactgacagccaatatctatggagcacttaatgagacgggcactgttagtagcacttctcaggtacctacctatatatgtatgtataattattatttccaatatacagatgagaaaatgaaggcacggagaagttaagtaccttgttcagatcacagccaggaaacagagaaatggggattggaagtcaggcagtcttactccagagtctgtgctcttgagacaaggttggcaaatgtgttctgtaaaggcccccatagtaaatatgtgtaggccataccatctctgctgcaactactcatctctgctgttgtggaataaaagcagccatagacaatatgtaagtgaaaagccgtgtttcagtgaaacgtattcacaaacataggcagccaatccctgttcttgagacagcatgctgtacagggggacaaacctcagactggctgggccctgaccccctattcttccttctaccactcaccttcctctaccaccaatagtaatagcaacagccacagcatttgtagaatgccggcttgagatggtcatacatgataatcatatgtcagggtaggattaagggaccatgatttatctcaccacccattagcaggtatgatggttaatttcaggcatcaactggaagaacgcttctggatgagatgaacgtttacattgaggaaagaggattgttcgtcatattgtggctgggcctcatctaatcagttgaaggcctgaatagagcaaaagtctgggcctctacaagcaagaaagaattctccagcaggccgcctgcaacttcacctgtaccatcctctcctgaatcccccacctgccagcccacagatttggactcagccgcctccatcatcatgcgagtcaatggctcatcataaatttccttccgtatgtatgcgtatcctattggtctggttctctggagagccctaatacagcaggtaaggtcgtagctagatggttgaggatacaaaactgcttgggagtggggaaaagggtgacaagtgctagaaacacatagctgagcaccagcaaagaagttggatgactccagatgtcctctccctggtttccctaaggtttggctcaggtcactgcagtcatctctccatggagcagtctatcaccccagaccactgctgggctgaagcaagcccaggacagcatttgctgtctgactggccctgggtccctggtttgttccatccaaaggggtatggatgatagggtagtataaatgcctcctgttgccataatctcttccttcatacgcatttttaaaaactatttaaaaaagaaaaagaaaagtaaagagaatccactccctggcctttttcagttttacctttttttttccttttttttttctttttgagacagtgtctcactctattatgcaggctggagttttttttttttctttttctttttctttttgagacaaaacctcactctattacgcaggctggagtgcagtggcatgatcttggctcactgcaacgtccacctcgggcttaagcaatactcctgtctccacctcccgagtagctgggaccataggtgtgtgtaccaccacgtccagctaattttttttagagacagggttttcctatgtggcccaggctggtctcaatttcctatgctcaagtgatccacccatctcagcctccccaagtgctgagattacaggcatgagccaccgtgcccggcccctccacacaccttttaaagtagtatttctaaagccagcttgtctgtagttgctgcattccattactccacacttacaggcaaaataccccaaaatggcctgtaatcccaacagtttgggaggctgaggcaggcggatcacttgaggtcaggagttggagaccagcctggccaacatggttaaaccctgtctctaccaaacatacaaaaattagcgggatatggtggcacatgcctgtaatcccagctacttgggaggctgaggcaggagaatcgcttgaacacgggaggtggaggtttcagtgacctgagatcatgccattgcactccagcctgggcgacagagtggaactccgtctcaaaaacaagcaaacaaacaaaaaacaaaaatagagaaagaagaaagatgccagggagagagataagaaagagagagaccaggggaaagttgaagacagacctgagatggggagataaaaaaaaaaaaaagaaaagaaaagggaagagaaccagagctaaggaaaggagaaagggaataaaaaacagaaagcaggaacaccagagagattcataaagagagacagagagagaaagggagaggaaaggaggcaagggaacaagagacacagagaggacatgaaaggtagggagagaagcctgcagagaatcacaaaaaaaagaaaagaaaagaaagaagaatcagaggatagagacaaagatgagagaatgaacaacctactcaaacaacaaaggcttttgagtacctctaggatttctcaacttcagcctattgatatttagagctggatacttttgttgtttttttttttagacagaattttgccctgttgctcaggctggagtgcagtggtgcgatctcagctcactgcaacctctgctgcctcctggattcaagcaattctcatgcctcagcttcctgggtagctgggattacaggtgcataccatcacactcggctaatttttgtgtttttagtagagacaaggttttgccatgttggtcaggctggtctccaaatcctcacctcaagtgatctgcccgtcttgacctcccaaagtgctaagattaggatcatgagccactgcgcccagcctggatactttttttgcgctggggactgtccaatgtcttgaagggtgtttagcaacatctctggcctctacccactagatgcctgtagcaccacctcccacagttgtgacaaccaaaaatgtcttcagatattttgtaaatgtcccctgtggcaaaatcaccctttgttgagagccactgagttaaagggatgcaatttttcatgcttttcagagcttaaattatatataaccaagggaatgatgggcccatggcagacagagaatacttaaagcccattttcctggagcactaattgtccttgatggtattttaaagcattatttttacatgaaaacaaatgtgggtatattacagagtagaatctcaaatttaaggcttggaagaaattttatgtctgaggtggggtgattttggctatactcccagaatccttggcaggtacacatttacatttctctgccttggaggaagctaataatagctaccatttattgagtgcttacaggggccaggagctttagaaattatttcccatttgatcctcactgggtgtttattattaatcccattttacagatgaggagactgaggcccagggaggtcgtgaaaccccattcaagtactgacagtgactaaatgatggagctcgcattggaatcaaacaaagtctgtctcactaagtatctgccaaaaagcttatgggaaggaaaaggtgaacagtgataaaccaccaaagtcaatatcctagtgctaatcaacaggatggcttaagaaaaagaaaggctctgttgaaactggcaaactcttaacttgtcttgggtggagagggagaaaaggggataggggttgaaaatgaagggattcccgaggtaggcaccacccctcaagtaggaaatagttaatcaacttgacagcatcaacttgaaactccaggctgggcatgctggctcataacctctaatcccaactttttgggaggcataggtgggaggatcgcttgaggccaggagtttgagaccagccttgacacaaagtaagaccctgcctcgacaaaaagttaaaaaattagccgggtgtggtggctcccacctgtagtcccagctacttggggagctaacgcaggaagatcacttgtggccaggagttcgcggatacagtgagctatggttggaccactgctctccagcctgagcagcagagcaagaccatgtctcaaaaaacaaacaaacaaagaaaacaaaacaaaacaaaacacctaaatcttagcctgagatccctcatgcaatccccagctgggacatccctcaggaagtttcttttcttattttattttatttatattttttatttatttatttatttattttattttattttattttttttattgatcattcttgggtgtttctcacagagggggatttggcagggtcataggacaatagtggagggaaggtcagcagataaacaagtgaacaaaggtctctggttttcctaggcagaggaacctacggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgattcagagagcacagggttgggggtaaggtcacagatcaacaggatcccaaggccgaagaatttttcttagtacagaacaaaatgtaaagtttcccatgtctacttctttctacacagacacggcaaccatccgatttctcaatcttttcctcacctttcccccctttctattccacaaaaccgccattgtcatcgtggcccgttctcaatgagctgttgggtacacctcccagacggggtggcggctgggcagaggggctcctcacttcccagtaggggcggccgggcagaggcgcccctcacctcccggatggggcggctggccgggtggggggctgacccccccacctgcctcccggtcggggcggctggccgggtgggggggctcctcacttcccagtaggggcggctgggcagaggcgcccctcacctcccggacggggcggctggccgggcggggggctgacccccccacctccctcccggactgggcggctggccgggcggggggttgaccccccccacctccttccctgacggggtggctggccgggcagaggggctcctcacttcccagtaggggcggctgggcagaggcgcccctcacctcccggacggggcggctggccgggcaggggactgacccccacctccctcccagacggggtggcttccgggcggagacgctcctcacttcccagacggggcggctgccaggcggaggggctcctcacttctcagatggggcggttgccaggcggagggtctcctcacctcccagacggggtcttggctgggcagaggcactcctcacatcccagacggggcggcggggcagaggcgctccccacatctcagacgatgggcggccaggcagagacgctcctcacttcctagatgggatggcggctgggcagagacgctcctcacttcctagatgggatggcggccgggcagagacgctcctcacttcctagatgggatggcggctgggcagagacgctcctcactttccagactgggcagccaggcagaggggctcctcacgtcccagacgatgggtggccaggcagagacgctcctcacttcccagacggggtggcggccgggcagaggctgcactctcggcactttgggaggccaaggcaggtggctgggaggtggaggttgtagcaagccgagatcacgccactgcactccagcctgggcaccattgagcactgagtgaaccagactccgtctgcaatcccggcacctcgggaggccgaggctggcggatcactcgcggttaggagctggagaccagcccagccaacacagcgaagccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagctttggctcggcatcagagggagaccgtggaaagagagggagagggagaccgtggggagagggagaggagggagggggagagggagagggagaggtagagggagagctatattttttattatactttaagttttacggtacatgtgcacaatgtgcaggtttgttacatatgtatacatgtgccatgttggtgtgctgtacccattaactcgtcatttactttaggtatatctcctaatgctatccctcccccctccccccaccccacaacaggccccggtgtgtgatgtcccctttcctgtgtccaagtgttctcattgtttagttcccacctatgagtgagaacatgcggtgtttggttttttgtccttgcaaggaattttctcttcagcctctgacctatggattcctcgtttcagcagtgcctatggctgcagtatctccccacctcccatcatcgtaggaccatcgacccaggctgtcacatccatggactgctctctctgatttgctcactacttttgctgctttaatgaactcagtcttttacaaaacatatttatttaaacgaaaaggttgcttttccttaccctgaccagatcactagaaaaataaatgcagccatgcacagtggctcacgcctgtaatcccagcactttgggaggccgagggggggtggatcatttgaggtcagaaattcaagaccagactggccaacatggtgaaaccccatctctactaaaaatacaaaaattacccgggcatggtggcgcatgcctgtaatcccagctacttgggaggctaaggcaagagagtcgcttgaaccctggaagcagaggttgcagtgagctgacatcatgtcacttcactccagcctagcaagagaggagactccgtctcaataaataaataaaagggaaactttatatcagtatctgaaatgaaaagtctgcttttccataccctgactagatcactagaaaaataaatgcagctgggcacagtgactcacacctgcaatcccagcactttggaaggccgaggcgggtggatcacttgaggtcaggagttcgagagcagcctgacaacatggcaaaactctgtctctactaaaaacacgaaaattagctgggcatggtggtgggcacctgtagtcagctactcaggaggctgaggcaggagaatcactagaacccgggagcccaaggctgcagtgagcagagatcgtgccattgcactccagcctgggcaacaaaggcagactctatctccaaaaaaaaaaaaaaaaaaaaaaaaagaaagaaagaaagaaaaaaatgcaataaaaataaacaaggctaaaacaacaacaacaaaaacaaacaaccaaggctattaaatttagttagttagctagacagctgtctttgttcaaaggggagacttgttagctttggagaagtgttaaaagtccttagcaccgagccaagatgttcttggtgcagtcagagtaactgaaagaggtttgaaaagggaatcactttatctggatataagtcatcgctgttagtgtcaggttatacctggcgccatcatgcttcaacgatggtatgtgtctcatacctgaggaaataccggtatggggctcgttatgggttgaattgtgtttcccagaaagtcataccttcaagtccttgcctaattgagggttctcagtatctcagatcatgactgtatttggagagatgacgttcaaagaggtaattaggttaaaatgcggccattagggtgggtcttcagtcttcattcagtccaactggtgtccttctaagcagaaatgtggacatgcgccagcagggacacacacagaggaaaagcatgtgagaacatggtgagaagggggccaactgcaagctaggaagagaggcctcgggtgaaaccaaccctgctctcaccaccatcttggacttttagcctccaaaactgtgagaaagtcaatttccattgtttaagtctgtggaagttatggaagccctagtcaactaatacaggggttccctgagcccccacatgcattccaacagaggcaggagaatagggtttggagaccaggaacataaggacttcctagaactaaatcaaatggaaacacttcagctgtgatgggaaatatcttctccatttacacagggcgtaagccaaataaatgactttgtaagtttcctccatcctcttcatttacataaggcatacaccaagtaaccaatggaaattttggggggtatttaagcctccaaaaattctgtaatggggctcttgagttcctgtgctctggcccacccccactctgtggagtgtactttagtcttcgataaattctgcttttgttgcttcattctttccttgctttgtttgtgcatttcatccaattatttgatcaagacaccaagaacctggacactctccactggtaacacaaccatctggatttgagtcctgcctctgctacttccgagttgtgagacgctgagcaagttactctacctgtctaagcctaggtttccttatctctaagttaacattccagtctgcattctgtgtgaaagttggtcttagaattgggtcgttcttgttacagccaactaaaacagagtcaagaggccaggaggaggaaaaagcagtcagaccacattacatggcttccagaaagtaattcttggaaagcctggctgctggaactgcctgctggaacctgaagccagttttatctaacagctactggaaaaacctgctgtgaccttaagacaagttttgcccactgccatcactcaccaaacagagtttgccagctcccacagccttacccttgccgatgaactttctcaaaaaacaatatgtaacatttctccttttctaaaatgcctctaaacttctctttgttctttggatgtactaaagaccacctggtctgcatatatgctctgaattgcaatcctttcctcccaaataaaacattttaattttagagattcatctaatatttgacttccacatatgaaattgttaacaatatacacaacatatccaaggtggttaacaaagtttctggcacagagtagggctcaaaacaacaacaagaccgggcatggtggctcacacctgtaatcctagcactttgggaggccaaggtgggtggatcactcgagaccagcctggccaacatagcaaaaccccgtctctactaaaagtacaaaaattagtgggctgtggtggtgggcgcctgtaatcccagttacttggaaggctgaggcaggagaactgcttgaacccaggaggtggaggatgagtgagcagagattgcagtactgcactccagcctgagtgacagagcgagaccctgtctcaaaaacaaacaacaaacaacaacaacaaactactatgataacaaatgttggcatacttcctggcccctgtaggtttgaagatggttttatctccaacaaggtaagaggtaaggatcttggtacagtatcttggatgctgtacttggtactagggactaagggctccatcttcaacactaaccaactatggaggcacatagcaaacaaaataatcaaagctctagcttcttcaccaaagtaacccagatattttaaaaccacccagcttgtgtctcctgtactctttccccatttattcctctctcatcaggactggcctgtttcactgtccccttggaaagcttttcagcaactttttgaccctccgtttaacacctctacctctcagactcctaaagcatcttacccaggtctcactgcctgtaaatccgcaaagccaggctttgaacccaggcttctgtgattcatcacacatcccacaagtgacagagagatgcagagagctttcatttgccaataataataattagtcacccattacatataatttataatcattaattatagtgattcatataatgattaagtataatgtgaagttcttgccttccacactaagggtggttatggcttcagttagtggaacacttgctctgcgcctgccgttcccatgtgtcatcccatggattcctctcaccacttctttacagaaattattttataactcccatttgatacacaaggacactgaaatgtagggagccccatgtcaccaccagcacatccactgcttaagagactctgggagagatcagagggtagacagggaaaagatgaagatgatgttagaaggcagcaggggaccagacacggtggctcatgcctagaattccagcactttgggaggccgaggcaggcagatcacttgagcccaggagtttgagaccagcctggccaatatggtgaaaccctggttgtctctactaaaaacacaaaaattaggtgggtgtggtggcgtgtacctgtagtcccagctaccagggagactgaggcaggagaatacttgaacttgggaggtagatgttgcagtgaactgagattgtaccactgcactccagcctgggcaacagagcgagactctgtctcaaaaaaaaagaaaacaaacaaaaaaaaagaaaacaaaacaagaaagaaggcaggagagggaatgttttcctcacctcctcttgagtctcctcagcagggctatggcctccagatttctctgctttaggagagtcagctaatcctccaccctggagggaggacagttcataaggatcacttagtcttctcctgatctaatccagctgggttagtttgctacaactgctgtaacaaagtcccacaagctgggtggcttatgcaacagaaattcattatctcacagttctggagaccagatgtccaaatcaaggcatcagcaggattggtctcctctgagggctataagggaagaatctatttccaggcttctctcctcatcatgtagattgctgttttagtctgtttgggctgctataaccaaatactgtagcctggatagcttataaacaaagcaattatttcttgtggttctggaggcggagaagtccaagattgagccatgggcagattcattgtctaatgagggcttgcttcctggcttgaagacagccaccttcttgctgtgtctttggacatggcctttccttcatgggtgcttgtggagggaaagaaatacctctctcccttgtcctcttcgtataacggcacgaatcccatcatgagggattcactttcatgacctcatctaaacctaattatctcaaagacctcaccttctaataccatcaaactggggatgcaggcatccaactgtgtccacatctgaatttgtgggaggaggcacaaacattcagctcataacaatggccatattctccttgtctcttcacactgtcttccctctctgcaagtctgtttctgttcagatttcccctttttataaggacaccagtcttattggtttaggttccaccctgatgaccttgctttaacttgattacctctttaaagacctgtctgcaaataaggacacattctgaggtgccaggggttagaactttatataaatttgaacacagttcaacctgtaacaccagtcacatgggcatgcatctcaagtttaatgatttttcctaatagtccagctccacctgcatctgacatctttctccaacaggaaaatattcctcaatcaaacacaacccttctcctgttacagtttaagctaatcttccattctcctgaaataataatatcccctgcctttatttatttattttgaaccttaagtttttgactctcctcatagcagaacaaccactcctcctcctccaattaaagtatacaaagtaaggaaattgagaagataaatggggaggggaggatatccacatcattctttttagttcagaatgagagccagttgctgtcaaggactggaaaaggaaggtatgctcatggttgtggttcagaagcctgagagctttggtttaaaaataggtgaactgaaataaacacagagctactcagatggcactgaaatagagtggtaattgatctaatgcaacttttgcctcggataacatcattatttgtgaaattatgtcagtgttgctactgccaagtcagcaagcacttacaggacgtgacttctaatttaggaattggactatttgtggcacatcttagaagacagcaggaactcagtggacacccggtagccagccttctgagagccttggtttgagcttgaaattcacaacgttgaagtgcccaggagtgccctgtcttgatgacccttcaaggaaaagacttgctgcccagctctagaaaatgtggtttgcaggtggctgtcggctgtcagttccttcatggtctttctcagctgcaaagatttgctgccccaggtcacgcctttcttggggcaacctcagcctgtgacttagtgaaacaggggtataaactaaggcctgggtactttggccccacttgggtcattctgatataatccagtacttgctccagagctccctgccaggtttcacgaggtttttcctgttataaaatacagttacagtctctctttccccagattttctgtctttttctagaaaggaggcaacaacaccttacatgacttacttattcccaaactgctttatccttttttcctaggtattattcccaaataaacacttgtacccagattctaattcaatgtcttccagaggacccaatctgggacagatgtctaggtagtttacaaagtcactgcacacttcctttctacctgtcatgctcctgaaagacagggggtgacattgtctcttcatgccctcattgagctggctgtagaattcttttgtggaatttcaagtggaagaatattttacattatttaagaatataataccagattttcatttatttcaccttcatgaaatgaggtacatgtgtaaaaattatggttagaaagaacagctcttttatttatttatttatttattttatttatttatttatttatttatttatttgagatggagtctcgctctgttgccaggctgcagtgcagtggtgcgatcttggctcactgcaacctctgcctcctgggttcaagtgattctcctgcctcagcctcccaagtagctgggactacaggcacctgccaccacacccggctaatttttgtatttttagtagagatggggtttcaccatgttggccaggatggtctcaatctcttgacctcgtgatccacctcctcggcctcccaaagtgctaggattacgggtgtgagctaccacgcctggcctcagccatttctttattcactttttttttgcccaattgcagtgtcccagacactgttcaaggtattgtgaatattatgatgaaggagacaaagattctcagagcttacattttatgggagcagactgacaatacacaagtaaataaatacattggtgaggaagtacagatgtaactgtagtaggttcattggctgatgcatgcaacaagtcaatatgctgagacactgggttgccgcagagaaagaggtttaatcatagggtcactgaatgaggagatgggaggaaaccttaaatccatttccctgagaagtttgggcttagggtttttaagggttttggagtgggctgatgtgtggagatcactgattagtggaaaagtgcaggatgaagtcatggtacaaggagatgaagaagctgtattctggccgagcatggtggctcatggctgtaatcccagcactgtgaggggtggaggcaggtggatcctttgagcccaggaggtccaggctgcagtgagctgtgatggcaccactgcaccccagcctgggcaacagagggagaccctgtttcaaaaaagcaaaacagaaaaggagccatattcccttgctgatccctttcctctgtggggggtcttctaacaagttgctggaattcagggtctgaaaaacatctttaaccaaagccttatgattctaatgtcagagatcttatctatatgaatgaaggggatgcaaatctattctttttttttttttttttttttttttttttgagacggagtctcgctctgtcgcccaggctggagtgcagtggcgggatcttggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgcaaatctattcttaaacaatctcatgacgctaatgtcagaaatccctctgtaggaacaatgggaatgcaaatggttagtatccagtgctacatgacttttaacaaaaacaaattgagtcaaagtccagcctgattaatgcttaattatagctacatttatgtacagaacctggcatgcaatgcttgtcaaccctggggggacagtttcagatactaaaacccgtgaagaaaataaagtagagaggatagtagctgttgactggggtatgcgaagattcgtttgatcaaatggttaggagagacgtttggagaaggtgacagtagtgttgaaacctgacaaagaagatccagccttctgcagatacaatgttacctgttggaatcgaaaagacccgcaagttctagtcaaagttgaattgaaccaatggcatcatctaatggatggagataacaacttgttcaggcatgtttggagtacctgctgtcacgccaagctctgtgcagggccatggaaacctagctaagccaggaacatccaagagtctgagccattcacaggctaaagacagagcagagtggagcacctcaccccggcaccttgacttaaaccgtgtggttcatgcatctgttcagagctgtcgatcaaaaaatgttcagagttctctgtccagatgagaccatttatgtctgtgtacccctagaggggagaggcaaaagcattagttattgtctctattttcccagacttcctgtctttttccaggtaggaggcaacaacctcttaaatgacttgcccgttggaaatgagtggtgttgctgaaggcccagctcaaattctcagactatgtatgtgtgcaaggaatgctcattacgccccatgagctggtatttccgagtcaagatacaatgcatctggatagctttttttttttttttttttttttgagacagggtcttgttcagttgcccaggctggagcacagtgactcaatcatagctcactgcagcctagaatgccagactcccgagtagctgggactacaggcacacaaccaccatgcttggctaatttaaaaaaatttttttttttacagacagggtcttgctatgttgcacaggctggtctcaaattcctgggctcaaattatcctctcattttggccttccaaagtgctgggattaaggtgtgagccactgcacccagctggtgtgacatttcctatccagccacatatctcatcctatttattcactcctcataccttcatcctttgcacctgctgttccctctctgtggtgcctctgtttacctgatgtactcttcatcattcataatctggattaagtgccccttcttctgtatatgcccccacccccaaaacacaaagagcattgatcactctcacctctaacctgtgctacagatggtacctcatgcgcctccttttctctcaaatggagatattgataatacttacctcctatggttgatctaagagttaaatgatatatatcaagattttggacccacacctggtcaactgtaagcacttaagaaatgtatgccaatagaattacatctctcagtcttggtgcttgaaatacttactaataatatctaacacttactgatcagttattatgtgtagccactgtgcttcattttaacatggatttgtaaaaaggcaacccttagcaaacctgatgaagtaggtactattactatcactatattaaaattgagaagccaggtgcagtggctcacatccgtaatcccagcacttcggaaggctgaggcaggtggtttgcttgaggccaagagtttgagacaagcctcgccaacatggcaaaaccccgtctctactaaaaatatgaaaattagccaggcatggtggtgggcgcctgtaatcccagctactcgggaggctgaggcaggagaatcacttgaacctgggaggcagaggttgcagtgagccgagatcgcaccattgctctcctgtctgcgcgacacagcaagactccgtctcaaaaaaaaaaaaaaaaaaaaaaaaaaaaattgagaaaactgcagtatgcagtgtttacagatgtttccatctttttcttctctgttaggctgtcaccgtttcgagggaaaaactcacaattcatttaactctctacctccagttgttagcatagcgtttttgggtcaataaatatttggtaagtgagtgaaggaataaataaagtaatgaagcagagaaagtatcattgtttaggaggtgaagaaatgaggacgacccagggaagaaatagactgaggataaaggtgcagctttttccaatccagagtccacatggttctctattaaaccagggcttcccatacctggacatgcataggaatcacctgggaaccatgtgaaaatgctgattctgagccaggcacggtggctcatgcctatagtcccagcactgtgggaggctgagatgggcagatcacttgaggtcacgaggttgagaccagcctggccaacatggtgaaacctcgtctctactaaaaatacaaaaagtagctgggcatggtggtgcatgccgatagtcccagctacttgggaggctgaggcatgagaattgcttgaacccaggagccggaagttgcagtgagctgagatggactccagcctgagtgacagagtaagactctgcctccaaaaaaaaaaaaaaaaaaaaaaaagcagattctgatctagtagatctagggtgaaacccaagatactgcatttgtcataatctctcatgtgacacaattagtctgtgatcacaccttgagtagcaaagcactaagctacttgtgtcagttggttctatgcttgccaacatcagaggccaactcaggctcacttaagtaaaaaaaaaaaattgaacttactagggtatgcatggggaagcacccagaatccaaggagaagtacagaacccagccccagcaaggacaggaactaaagcactttgggttttgggtttttttttttttttttgactttatgaacatttattataattattttttatttacataggttattggggaacaggtggtatttggttacatgagtaagtttagtggtggtttgtgagatttttgtgcacccatcacccaagcagtatacactgcacccaatttgtagtcttttatccctcaccctcttcccaccctttccccaagtccccgaagtccactgtgtcattcttataccgttgcatcctcatagcttagctcctacttatgagggagaacatacgatgtttggttttccattcctgagttacttcacttagaataatagtctccaatctcatctaggttgctgcaaatgccattaattcatttatttttacggctgagcagtaaggaattaaagcactttgaacccaaacagggaggagggggtcccttgctgcgaatcccactgtcaggagaaatcagctccaactatgtactgcccttaaatcactccatccaaagtttacatttctgtgcgatggtatctaattgactcagtatgaatcacttaccatccaaggcaaaggaagggcagaatgttttgattgacattctcattaagaccatgtgcaatgaagaatgggcattttcttggagaaaaatgttggggtttttatactaaaagaaaggagacattaagttaccctgcccaaagtcagagccaccagctctggggcagatttaaagatgaatgtgagacttttggacacccctccaccaccgaccccagccttcctgagatggtcagctggaccactgagcatccccagtgactttggcagagactgattctaaggttggatgggccacagagattgggctcagaatggaaactgatcatcaaagtgatccttaattctcgcattagatttttatccagacgtggtgagcaaagtggctggcctactcctctggtttatgtggtaggtcataggtggcacagtgcctgcttagcagggatttaaacaatcccttatcatcttctgggctttcttgtttgatttttttttttttaactttgttcaattctcagcaactcgattttaaaggtcattatattaactgcaaagatgaatcaagggatgaggtcatttctcatccagggaaacgctttagtcttggatgctgtcatcttcatgctccatagatgctgatctgggctttaaaaagacaattctatttcaacatagtattctttggggggaaaaagactgccttcctttccaaaactcagctttgccaactcatcaaaggaagcctttgtatccacatttgtgtccctcatatctgggacagcagctgcacactcaaaagtcctactccagctgaagggagtcgtggactttatcgtaatcaccttgttgaaatatgtggaattgtatagcaacagccaggttctatgttgccataatttatgacaaaggctcaaataaatccccagacatggattttctataaaatccttcattgtgaaagtttgttgcactgcaaaaatgaaaagaagacggaaagaagagaaaggaggaaatgaaaaagtccgcaagacgtatataaacctctgaggatgccgtttccattcatcacctttactgtaaagacagggattttatttggatggaaaaggaatgaatcatagggttttagaatctaatgcgaagtttgctggaagcattttcctctgatctttctgcttcctcaagatcatctgaatatggagagagaatgagtgcaaagaattctatcagccatagaaggttctgtgctgggatgggtatcagaggatggagagagatctctttttttgtgacttttacctgggacgttcattggcctgtgaaggtttagggatacaatatagtgacatcagaagcatgtgttagtgatttaaattatacaatatgaggtgagcagatgcaagaacaagagaaagagagagtggggagagagggaggggatgaagatggagaaggaggcaggggaaggtgaggacgaaagtttccaatcatatagtttatttcatccaccctcccactcatagcctgagaaaatctgattctagagatcccttcctttgctcttttgtccctcatactatgagcatctactcttgctaggtgccagacagctgtttttattcagtatgatcccttaaacacaaatcaacctcttcatcagatgctcttcccaaaacacagtggtttgttcaagatagacggaaaatggactgtgttggacacattgagagactatctgcttcttcaaagcatgggtgacttaagaggacttttaaggaaaattctgactatgcgattgtttctttatgtgatacctctagaatctaattgcctcttaaagttactctctactggggtcccttctgagcagttaggggatgaaggttatggttaggtctaaatttattcattcattattcaccagatacacacggagaacctcctttgtgccaggcatagtgctgagctagggcgagattacatggtgcttcaaagagaagtttctcactgatctttgcatgcaatcacaaagtttaaagctggaagaaccctcagaggatatcatttatcaagaacaatgttgagcaaccttttatatgcaagcactgctttggggaaaataaacatgttttactcgccacattcttttggctcattcatagtgaaaacagttttattgagttccttggctgggagggaggacattctcaaaacccagctcccctatttgatggaatagaaggccattgattaaaaacttagcattgcttgtgggccactaaaatgcaaatattggggtatctttgggaagtagttccatggaggtagttttcagattgttcaatctaaaattaggtggtggtctgtgtcccaaagtttaggcagaacacacgtggctcccaggctgctggtgttcatggtggaggtagtgagtgggaagctgtgcttggtttcattctagatcctctacagcacagtacaaaataatccttttctggcttaggtatctgttttatttagagcccttgtggttgcaaactctgaaagaaaaataaaattgaaggtacaaagtctcacaagaattcaaaagctgaggtgttagcattaggcatggcagaattcagatgtttaagccatgtcattggtaccctacttttccatttactccattctgctttcctctctggtggcttcactcccaagccaggtgtgctctgtgtgtgtgcatccaccacccagccagcagagccaggcttacaccctcccaaatttaagtccagtaggaaagagttgcttccctctaggccatgcttgctccagatttggaattagagctgatgggctctgcctaaccatgaatccatctcaatggtctgattggccacgatgggtccactggtcaaggatagggccagactaatgtaagacatatggatagagagtgaggcttactgaatgaagccaggtgatcctgaaaatgcaaagactcttcatcatcttttctatctggccattcatccatctgtgtgttcgtccatccatctgtgtgtttgtccatccatccatcccctgacctatctacctatctatccattcatccaatcatccatccatacattcacctatctagatatctatccatccacccaaccacctagccactcagataactagctagctagtgactgcccctttgttgtagaaagcaattatatgttcagagcatggcatatcttaggagttctaaaactcctttgttaaaagtaaatgaataaatgaatttagccttattctcaatttatacacattgtgaaaaggtgaatcacaacagctaatgccagagctggactctgcacccagtccccacaactaaaggtttctcaggaagatgttgcttcaacaggtggggaataggagattgctggcaaggcagatgtatgtgaattattgcctaaatgcaatggcattttatgcaagggtatacttatctgtggtttcattaaccagtattcattttcatctcagtatcatatctatcttttcaggaaataagtttactttcactataaagctacatctcagaaatgaatgcaaataacaattttaatgtcaaagccaggtccattttttatggctctgtgccctaatccataaagttattacccaaactattgaaatatgccccaaggatcggcgtcttaataaggctttagaaattaccacaatatttgtggagagaatggggatgcagggcgtctgaaacagttgccatgaaaaatgcttaagtagaggtcaacaaagtttgaaggtgtgggaatgggcgggggagtggtcaaacgtgtcttcacctccatctttagtaatttctacatatatgtgatttttttgggtcacgtatagctgttttttgtttgttttttgttttgtttgttttttgttttgtttttgtttttgtttttgagagggagtctcgctctgttgcccaggctggagtgcagtggcgcaatctcagctcactgaaagctctgcctcccgggttcacgccattctcctgcctcagcctcccgattagctgagactataggcgccaagtttagatgtcttataagcccaagactatatgataaatgccttatttgaattatagctgtgttattgtagtgttttgtgcccaccagttctaagatgtaggttcagcctaaaatttctgattgactatttccttacattgtaaaataatgggagttgggactcttgggttcattcatttgctcaacaaatattaattaagcatatactatgtgccaggcactgctctgagatacaacagtgagcaaaccagataccaatcttctcccttatgaagcttagacagtgcagtgccaggttctgccatgaaggaacggttagtgctttgcatgccatttgccttctgtgggcatctgttttcctgtttgtaatataagaggcaaggggactcaacaccaaccaaacgaaaggaacaacttaaaaaactaagcttggcaaaaggaaaagttacacaggacaggtaacctatgtgcaaacactgagaaaggtgtttggtttaagagcaaggatactacttgacactagttgatctgtgtggctcccaaagacaggatgaggactgctagacactgagatcaaccatgtataagatgctgaggagggccgggcacggtggctcacgcctgtaatcccagcactttgcgaggcagaggcaggcggatcacttgaggtcaggagtttgaaaccagcctggccaacatggtgaacccccgtctctcctaaaaaatacaaaaattagccaggtttggtggcacacacctgtaatcctagctactggggaggctgaggcatgagaattgcttgaacccgggaggcggacgttgcagtgagccgagatcgtgccactgcactccagccagggaaacaaagcgagaccctgtctcaaaaaaataaatttaaacaaaaataaataaataaaaattaaaaatttaaaaataagacgctgaggaggtggcaagtttcttatcactaagagtgtgcaagaagaggctggaagagaacttggcaggatattggagaagatgcaagtatcagccttctaaaaactctttaacatatgagtgcaattaacattactatcttccatctcagtactgcaccatgacgaccttgtggcctgcatgtttgtggcaataggataagagaaagaagggggagacctcttaactaccttggccagaaagtgacacctatcatttctgcttacagtccattcaccagaatgagtctcatggccccagactaatatccaggaaggccaggaaacataagtgagaacatgaatataaggtaagcaccatctctaagattttgaaaatatggagagacataataacacctatttcagagagttacttttagaattaaataagctaatccattgtgtcatctagtaacttttcttttttttaaacgagcctttctttcatcctcttcctcttttatttgacttcaaagatcaccatattatctggctggacccattgaaaagatgctctatggagcccctaggagaagtcactgatgaaagggattgatcttatatggacatatccccacacactgatgcctaaaattccaccattagaggcaccttcctgccacgtttcacgtctctaggcttggggtaggcaagggatgtggagggtggacatggaaattccaggtgggaagctgtcagtgacaatttcagccaggctggccctaaggaggatggaggttgcatagctcagaaacccaccacccacgggttgctgttatatatgcagttagaaaggctgtttccccccagtggagcaacctaggggcaggctgtccatctgaatctgaaatgaattcaatttagcttcatgtaattgcttatttgattcctgacgatgacatgcagttaggaggtaaattgacattctgtcatttctgttccaatgaactgaactccaacaagttccctcctaggtactttgtggcagccaggccacctgctcttcttctgaagagaaattagcgagcacagggagcttggaaatacagcatcccgagcctggtgcctttttttgttgttgttacggttgtgagatgaatcacatagtcagacaggggtacgcctgaacttccttttcccctggtgaacacaatagacgtcctttcagaaagctctcaggatgactttctgctttagaaacatgaattttctcgcttgtcatccaaagtttatttctgttcaaggtcaattttgcaaaaaaaaatcaaacaatataggagtccgttttgaaaaaagatttcaaacaatttaggagacatctccagcaagtcataaaagacctcacccgttccaagcacaggaataggtgtttgttttgtcgtggctacccagtgccctctttggccaagcctttatataaccacagcattctgaatggtgcccacaaggctatgggaaaaggcagtcccttcaaacaaaggggaggccagccaggcagacaggacagggctcgacaggatgctcagaatgtgattgaagggtgagcaagaaccttgaattttattgattaaagacacaaattctcaagggcataaatagagggcccagatgtcaatatccacagacaccaagccttctgtgtatactggacagatgtcatttacatgatcatggtaagaagaatatggtattgtaagtgatatggtaagaaacaatatgaatattaaaccatgcagcagtgcttctcaacaggggcaatttggcaatacaaagacatttctgaggctgggagcagtggctcacgcctataatcccagcaatttgggaggccgaggcaggcggatcacaaggtcaagagattgagaccatcctggccaacatggtgaaaccccgtctctactaaaaataccaaaaaaattaggtgggcgtggtggcgtgcgcctgtagtctcagttacttgggaggctgacgcaggagaattgcttgaacccgggaggtggaggttgcagtgagctgagatcgtgccactgcactccaccctggagacagagtgagactttgcctcacaaagaaaaaaacaacaacatttttggttgtcacagtgagagggatactactggcatttaatgcgcgcaggccagggacgccgctaagcctcctgcagcgcacaggatggcttgccacatgatggaatgaacaggtccagactgtcaatagtgctgagcttgaaaaacctggtagagagcaaggggccaagcacgtgacagtgtccacttaggagaagtgatgtcggctgtgttaggaaagacagtttccgctggacttgggggaaagttcatgctgagttgagaaaggtgaaatattctcatttagaatcacaaatgtgatcacatttcttctctgtttaaaataattccacactgtatgaaaaaatcaggccaagcacagtggctcacatctgtgatcccagcaattttggaggccgagatgggaggattgcttgaggccaggagttcaaggtcagcctgggcaacacagtgagaccctatctctacaaaaaaaaaaaaaaaaaaaaaaaattagccaggcatggtgttgcatgcctgtagtgccagctccttgggaggctgaggcagaaggatgggttgagcgcaggagtttgaggctgcagtgagctatgaatgtgccactgcactccagccttgggggcagaccgagacactgtctctaaacaaaacaaaacaaaaaaaaaaccataaaaacccacaacaccaccttgtaccctataaatatatgcacctataatttctcaatatataataaaaatgtataaaaaaagaaacatgtttttatttaacatttaaaaaccctgggtcaggcgcagtggctcacacctgtaatcccagcacttggggaggccgaggcggggggaccacttgagatcaggagtttgagaccagtctggccaacatggcgaaaccctgtctctactaaaaatacaaaaattggccgggcatggtggtgtgtgcctgtgatccctgctacttgggaggctgaggcaggagaattgcttgaacccaggaggcggaggttgcagtgagccgagatcacgcccctgcactccagccagggcaacaagagcgaaacttcttctcgaaataaaataaaataaaaatacaaacctgtattggttttctattgtttttaagaaaaagtccaatctgtataacacagtcgccaaggccctgtgtatatagttccctcatcttctgcaggaaggagaggaaaaccagaacttagggaagggacattggtctgagcaccctgccttcaatgtcaagttaatgagaaaggttagaaaagaacacttaaaaataatctgtcactgctatagttgcaaacaatggggaaaagaggaagtggtgagaaatgaatctgtcatgcagactccatgagggttattagcagattgatcctgaaagagcaagaaaggtctgatttgttggtaaaatactcagctataatgaaaacaaaaaagaggagaatcatgcagacatccttcctcctccatcctccatttacagtcaaagccttgtttcctccacagcagctcttaggactctgggaaagaaatggctgatgaagaaattttggagatttgactgctgagtccctagtctggtattgttaagagtcatccaggaaagacacatgtcacccctcctagctctgctctgggttttgtttctctctggcacaatgtcctatgaagactggactataggtggcctggtcttattcgggttacacaccgctccactctgctcactgggcccccactgcactagacttctctcaggaccttcagtatcacactgcagcttcccacaagttcttcccacagcttggattccagcctctgcccatgtgtctccccttctacatccacacaacccacattatttactcctgttcatctttctgattgttgcgcaaacattatttctagagagattttcctgatgctgcccaacctggctcagtttcctttatctatacagtcccatgccctccttatcatacttataaaatgacatattcagtaggcttgtgtatttttccaccttttgatggagctccatgagaatagggaccaaggctgcccttatatgcactgtgtgaagggatctagcaaaggggcagttggggcttaaaactagccttcgatttgctgacctggcaaggcttggctgtcatacaacctggggtatccccagcacctagcacagtgcctgactcagagcaggtccccaggaattgtggattgattgacactgtctggctaggtcccagcaccatccatcatgagacagaaaaaaaaaaatccgcttcccaggcagagcagcctccaaggcccacatggcccacggcacctcctcatcagcacgcacttcatgctggccagccatcagccaagctgcaatctcaataaatcaagaggctggggcaccatttcccagggacctgccagagtgcccctgggcgcccaatgaggctgagagttctgctgccggtcgtggatcttgaactctcaaaagcaattggtgaaaaacaccaatggattgtgaaagaagtgatcactcctcctttcctctgtaggtagaggttgacagtcaaatctagtttcaaggtctctgtctctttgcggtcctaggtaaatacgatcatctctcgaaactttcattcctccatctgtaaaataggtatgatactcatccctaccatccaatgtgtggagatccacataatgctctaatatactaggttggtgtgaaagtaattgcatttttttctcataaaagtggcaaaactgcaattacttttgtgccaacctaatagtacacggcacagtatatacaatgtgtaatatagtacatagtacatagcagattatatatataaattatatatatacatataaaaataaacatacacacacacagacacacacacgcacatatatataatgaagcctcttcctttaatggcccaagattgagccaaaaggaaatacagggaattaaaccatgaggacagaaatctccatctaggctgtcttggttgttctgctcacattcccctacccaggcttgcaacctcccgtgaggctgtctgagcctggacacacccctagaatcttcattgccaacaaaagaagagaaagggaataaggggtatttgtgtggaatctgaaagagacaaacacactccttgttcttctcaatacaggtgtttccaaagctgccagagagacccagagcttagagttgtgatgacacaagggtaggtgatgtggacaatgaccggggcccccagccaaaaccatccctgtttatctgttccacagaatggtgttcaacatcagttcttgtctggtggagggggaagagattgtgctaatgaataaacatacaaagtagacaaatgtttatcactccttactagcataagattccatgcgtacaaaaccatataagctgtctatatgtgtgagtacagctctagaaagacagaaatgattgtattggatgccagcttaaagttgggaaataccattagaagaaatcgcaacttgagaatcttgcattttattgccaagtgtttggttttaacgagagtctaaatgtgctcacccattcactcatccctcccataaatattccctgtggcccattatgagtttgacactctgctaggctctggaagacaggcagaatgatggaaagaatcattttctagaaatgactaaatcctagttaaaaaggggaaatatttaaactattagtgacaatataatttatgcattccgctagtacatgcggaacaactcctgcatttcaagaattattctagacacgagggatacagtagcaagcaaaatataaagatttctcttttcatggaacttgtgttctagcggggggaaagtgcccaataaaaaaataagcgaataaatgcataattcatactagctagtgataaatgcttttatagtaaagcaggtaaaagatgaagagtgatgagaaggggctactgttttagatcaagcagctgggaaaagtcatttggaagaggtgacatttgggcaaagagctgaatcaaatgaggcagtaagtcatagcaggtggaagggaggtgtattccaggcagaagggagcaagtgagcgacagccctgatgagcagggtacctggaatattccagaagcagtgggagaaatgagtgcggctgaagcccagggagcagtggagagatactggggagagtggtgaggccacatcatgtaacacagcctgcgttgctgagcagccttcaacaggatgcaagccctgacaacgaaagaatagttaactcagaaaaaaacaaaaccaaaactaaaacccagctgctacggtaatggaattgggcaagcaaaaccgatagttcatgaaacacaggagcaagacacctgagacctggctcacccagcaaggtggctgcagagctgcttagacttggagaagcaggggattccctgttatttccaactaataggaggagtcagagtgcagaatgaagatgtgctctgctagccacctctagagaacatctctcctcatttttgactgcccagaacctacctatgctgagggaatcctcctggtctctgttcccacctttctctgcagaagctgataccagttttcccagcttcccttgcagctagggtaaaagcacgtgacctcatttccaccaatcagcttgcttgctccagccttcaccatggaagctggcatttccctcaatggtggctttccctctggaggctctaggggagaattccttctttgcttcttcatctgctggtggctgctggcattccttgaattctggctgcatcactctcattgctacctgcatggtcaggcttccttctcttctctatgtcttctcttctgatggtattaagactctttctgtttcactttttaaaaaatctcatttttatttattttttaaaatatttacttttatttcaatagttttggggaaacgtgtagtgtttggttgcatggaaaagttctttagtggtgggctgggtgtggtggctcacgcctgtaatctcagcacttcgggaggctgaggtgggcagatcacttgaggggaagagttcaagaccagcctggccaacatggtgaaaccctatctctactaaaaatacaaaaaaaaaaaaaaaatatccaggcgtggttgcatgcacctgtaatcgcagctactcaggaggctgaggcactagaatcacttgaaacccaggaggcagaggttgcagtaagctgaaattgggccagtgcaccctagcctgggtgacagagcaagactctgtctccaaaaaaaaaaaaaagagagagagaaagagaaagaaaagttcttaagtagtgatttctgagatttttgtgcacctgagtagtgtaactgtaaccagtgtgtagtcttttatccctcacccccctccccatgtacccccaagtccccaaagtctactgtatcatttctatgcttttgcatcctcatagcttagctcccacttatgagtaagaacatacaatatttggttttccattcgcgagttacttcatttaaaataatggtctctaactccatccagattgtcgtgagtgccattattttgtccctctttatggctgagtagtattccacagtatctatatataccacattttctttatccacttgttggttgatgggcatttaggctggttttatatttttgcaattgtgaactgtgctgctataaacatgcatgtgcaagtgtctatttcatataatgacttctgcttcgctcttaggacacttgtcattggattcagggttcacgtggataatccagaatgatttcctcatctcagggcctttaaattatttccatctgtaaagaccccatttgccaaataaagccacatttacagatttcagggattaggacatggtcatatctttttggaggccaccgtcccatcccctatgccacctcctagagatcttatgaactaactaatacctttttttttttttttgagctggagtcttgctctgtcacccaggctggagtgcagtggtgtgatcttggctcactgcaacctcggcctcccaggttcaagtgattctcctgcctctgcctcccaagtatctaggactacaggcacctgccaccatgcccggctaagtttttgtatttttagtagagatggggtttcactgtgttagccaggatggtcttgatctcctgacttcatgatccacccgtctcggcctcccaaagtgctgggattataggcataagccaccgctcctggccactaataacttctaatactttttttttccttttcgttgataccagcctgaattggtttgttttttgtcaaacagaagcttgacatggaccccaccctatctctctattcctggccaccaaagaggacaagatgtctggaatgcagccctgcttgggggcataagtgtgagactttggttccagctgatatgcacaactctctgccttcccgtctgctcactttgactcctgcctcgtagtaaaggaacggacctcccatgtcagaagctctgtggttgagacattttctttcaggttaaaacatgtcttctggccctaagagattgggatgtgaaacccaccacaaagagtggagggaagctggctgggtggtcagcctcaccacatcaactatttatggctttgttaaaaaataaaaaccagagcaaactcacccatagaaacctacagaacatgcatgagcctttaggagacttcaggagggacagtgttgtctcctaagctgtcttgcaccagtggtgtcggtgcgtgggggtgagaaaggaaatctcacgggaaactttccatgaatacttggagcctattatgagcaagaaaacgacaatatgacaaacacaagaagcaatatctcacggtggttacacccatgtgcttcagagccagagagatatgggtagaagcctgaaaactgataccactgcttaccatctgtgtgattttgaggattttttaaaaacctgagcctcagtttcctcatctttgaagggtattaatgcctgccttgtttttttgtctgttttgtgaggattaaatagattcagtaaagctcttagcttagtattggtgtatgtgaatatgtgaagacatcttatattcctttgccactattgtcatccctcttatctaaatagcatcatcttgaattcagttaaatctgtggacgtattgtctcttagtgcatgtgctgtactccacagtgtctggcacgtgataggtgctacatgaatttttggtttataaagctgtattgttttgatgggtgtgtaatcagagtttaacggaccagaaggtgacaaaattcaactgatcctcctagacatggtgccatatttctctggctccattctaactataatgccagtaatttcaatctccacctaaataaagctcatcactatcactcccccaccatgtctgggagtccctaggacaatgtctcacctgttcttgcatttctggtttgtttgggcatcagtgacacctgccattctctttctgctctgcactgcccactatggatgaggataccataggtgaagggttatgagatgaggttgaatgactgtgatattccaaaaatttccagttgaatcaaatatcactgagctctgcgaccctggctggctaagtcacagaatctttttttactttttgtgtgtgtgtgatggagtctcactccattgcccaggctggagtgcagtggtgcaatctcggctcactgcaacctccgcctctggggttcaagtggttcttctgcctcagcctcctgagtagctgggattacaggtgcgtgccaccacgcctggctaatttttatatttttagtagagatggggtttcaccatgttggtcaggctggtctcaaacttctgacctcgtgagctgctgcccttggcctcccaaactgctgagattacaggcatgagccaccatgcccagccatcacacaatctttttaagtctgagttttatcatctgcaaaatgggggagatctatcttcctcatagggatgatgattaaatgaaataatgaacacaaaaggaatagcctggtatgcattaggtactaaataaatgccaactatcatttttatctccttgatgaattattttcctagtggctataccaccccacatgccaataatgacttttggtagatatgccatatctagtcagatatttgggggtggtgggagagtgagctggtggcagagaaggtggggacagagactttctattatggcatctcggaggaataaaatagtaactgtcagaaacgtgatgctatagaaatcagctacagaaccagctatatggattgtgaattttttttttttttttttttgagacagaatctcgctctgtctcgcaggctgaagtgcagtggggcaatctcggctcactgcaagctccacctcctgggttcacgccattctcctgcctcagcctcccgagtagctgggactacaggcacctgccaccacaccaggctaattttttgtgtttttagtagaggtggggtttcaccatgttagccaggatggtctcgatcccctgacttcgtgatccgcccgcctcggcctcccaaagtgctgggattacaggcatgagccaccacgcacagcctggattgtgaagttttaactccagtgctgtcatttgctagcaaatgcccttgggtaagttctttaatcttgcaatgtctcagtttttaaatctgcaaatagggataataatacctatttcacaggactgtaaggataattgaataagttcattcatgtcaagcactcaacatgacttctaacatgtaataattaatcaataaatattgactattattagtttcccagtgaatcaatcaagaacgtacgtttttaaaaaaatccttaagtgccactttgtggatagatctgcccttaccgtgtccaagggatctatgtgccttcaaatgttcgagtcacatttcacctagatgctcagatatgcagaaattctaaggataaaccacctaaactactgctatgtgtacagacctgtgtacaaagggctaacatattgagctgggctttcttctttattggaatgcacccatgtttgctgatgagaattttctacctgaaagggttcatgaaagtggaagattgtacagaccatttgtgaaattttgtgtccaccacccagacctgggaagttcaacaatgtaatggctcctgtcttgacatgtcatggaatggtcaaggaaatgaacgggtttctcaggggtgtttggttgtaagcccaagaaactgactcaaatcagtccaagctttattggaagtattcaagcgtacttcctggagcacacagacagatagtatagttgggctcacagggtctagaatcagaaactggacctattagggtccaaggcaactcttccctctctctgctctggtgctttcagctagttcgcttcgtttcttcctttgcagagtgaccttttctgcctctcttgcccacaacccaaagacccaaaggtggccaccccatttttatgtcctctcagtactagtgcccccaaaaaactggcaagaacaaccaagtccaactccaaattcccaggggaaatgattggccaggaaaagaggccaaaaacatgtggtgactcacgaagactcaatctatggaaggaccacttgacaaagatccaagtcagaatcctctggggcattcagctggccattggctatttcaggtcggtacactgtcttctgcttcttgatgtctaggtctcggggaaggaccacgtggcctgctggctcatggggctccatgtacccttctgcacttctccaaagggccagccttttttgctgcaccagaggctctgctcatacccttccctctactttgaacacttttccctgcaccctctcgtcctacacttttgcatacctagctcctcctcctccctcaggtctcatgttaatttcacctccatggagagactgctctccacgccctacatttgtaactttctctggcgctctacatcccctatatgttccctttatggaactaacacagtctgaattaaatgcttataatagtagctaacacccacatgatatttcctacgtgctggatattttcataagagctttgtacatgtgaatttttttaatccatcaacaaatggggcaggcatagtgactcacacctgtaatcccagcacttaagtgatcaagaggatcacttgagctcaggagatcgagaccagcctggccaacatagtgaaaccccttctctaccaaaaaatacgaaaaattagctgggtgtaatggtgcatgcctatggtcccagctactggggaggctgaggtggaagaatcacttgaacccggaggtggagatggcagtgagctgagatcgtgccactgccttccagcctgggtgacagagtgagaccctgtctcaaaaaaacaaaacaaaacaaagctatggaataggcattcttagtctctcttgttccacaaatgagaaaactggggcacagagaggctagctaacttgcccaagatcactctgcaaagggtctagttccgtagtctgcactgtaagcctctgctgcctcttgaccccaacaacattctacagcttatgggattgattagttattttatgtctgcctcttctactggagtttaggctctgtgtagtcagggactgcactgatcaggcccactgtgtatcttcattgcttatcggaatacctggcccttagaaaatatttgccagatgaatgaacacatgaaaataagaatatattaactggcttaaaaaagaacaacccagattcctgcctgaatgagaagagggagccaggtaagtctcccaggactttaagggggtgtatgtgggattcaagagaggaagcttttccaaaaatagcagcaggagaggactgggagaagagatccttctcatggaatagcttgctttctgctgttgctgctgctgctgtcatttctgtcctgtggtccccttccacccagtctcaggttgccaatctgagcttaatggacctgctttcatgccctgagaggtgggagcagctggcattaataaatggagagcacttcaagaaacaactgagtagaggctcctgagatgtcctgagcttaggcatgagacactgatggtggctccctcttgacctggattgtttgtggcaggaagaacaaagaggttgggggtggaggaaatgtggaggggtctcgggagggggttccacctccaaatgtatccagaatcctattctttctcattttctccacctctatcacctgggccccagccatgtgggactacaacggcctcctaactgctcccccaggtttcaagcacccccccaccactctgctatcttctcaactcagccaccagagccaccctgttagaacccagagacccccagttcatgttgcttctctgctcagagccctccagggcaccacggaattcaaggcaaaagccaaagtcctggctggatgcagtggctcacgcctgtaatcccagcactttaggaggctgaggtgggcggatcacaaggtcaggagattgagaccatcctggccaacatggtgaaaccccgtctctactaaaaatacaaaaattatctgggcatggtggcgcacctgtagtcacagctactcaggaggctgaggcaggagaatcgcttgaacccaggaggcagaggttgccatgagccaagatcgcaccaccgcactccagcctggcgatagagcgagactccatctaaaaaaaaaaaaaagaaagaaagaaaagccaaagtccctgcaatggagcaaagtccctacatgatcctaggtgatctggttcccacccctcctcccacctcattctctcccttacccagctctcacctcccacctgccttgatgttccttgaatgttcactaaatgcaccagtcatggccctaccaccaggccctcactccagctattccctctccatgcaatactcttctccagaaagctgcttctccaaattcctcaccttcttcaagcctttgttctgaatgaagcctaatcgtcccatgaacgggacttactgtcactgcttgcacctgcatgaaaacaaccttatgcatggagagtgatggagatgagcgtattctagctgggcaaaggcagggtggcagaaaagccactctataccactgtggtcagagccagaggacccctgccgctgctggggtgagaacatgagtaatgaggtcaaagggaaattaagtgacttttttttccccattttccaagaatcactaactttttctttttctttgagatagagtctccctctgtcacccaggctggagtgcagtggcactatcttggctcactgcaacctccacctcccggcttcaggcgattctcttgcctcagcctccctagtagctgagactacaggcacacaccaccagacctggctaattgttgtatttttagtagagacggggtttcaccatgttggccaggctggtctcgaactcctgacttcaagtgatctgcccacctcggcctcccaaagtgctgggattaaagacagaaccgctgtgcctggccccaaatcactaactttcattgttagtgatgcaatttatatatatttttattttcatggaaaaaggctctaacaggaaatatataaagaatataaatacataaagaaaatgtgggaatcttgatcccattcacactagttcctcccaggaggtaatcactggtcttgcttggcatagatcctttatcagcgcatttgcaggcacaggtattttttctaccataaataaatggaatcagactctatgcattgttctgcaatttgctttttttattttaacttgagcatttctgggagatttctgtggcactccatagaggtctatctcatttttataatagcttcccattattccacgatgtggatgaagtgtaatttatttaacttttccactattaatggacatttatatccatttgaatttttacctccttctgtgattcataggctccaatagctccactaatgtcaagctttacaacgctgcggtataaatgaccacatttttctctcactgaatttgtaaacgtcttatcaacaacagcacgggggtagacgtgtgagttggttgcagatgccacgtgtgtgggccacggccgttccttctggaggcggatgctggctgcagtttgtctgcagtgtttcagtggggaagagaaagctcccagaagagggccccttctccatctcaaactccccccgttccccggccattcctctccttctcaggcatagtaaggaggccagcacagttcctaggattccaggtcaaagtgcatcttgccttttgacccaagaaccctatcccattacaaatggaatctcaattaattttacacttgtgggccgggtacggtggctcacgcctgtaatcccagcactttgggaggccgaggtgggcggatcacaaagtcaggaggtcgacaccattctggctagcacggtgaaaccccgtctctactaaaaatacaaaaaaaagttagccaggcgtggtggcgggcgcctgtagtcccagctactcgggaggctgaggcaggagaatggcgtgaacccgggtggcggagcttgcagtgagcggagatcctgccaatgcactccagcctgggcgacagagcgagaccccgtctcaaaaaaaaaataataataataatttgcacttgtgtttgagtatttcccttaactattttgtaagcctactctgtatgaatttgtggtttcctgccctctctagttacatgtctctgtcaatccctgtttctatctgtctgtttcccttttctctcctccaccgcaagatacagaatcccatcctctgtaggcaatcaatatatccttattaatgattattagaaacaatgctgggactgaggaagtggtagatagcaactctgggaaaatcagatgagaattcattactcaacatttcccaggtgcctcatccaagacctcatgcccgagagagcactcagtaccatcttattgattctaagatgctgcccttatcatgggacatttctaaaaccagcgtgggttctatgataaaagtttacatttaatacaatattttttaaataaccaagggcattttatagtgcttctttataatgcctcttaaattcctctaagaatgactcagtagaccctgaccataggaacggagtaaagaatggctacaaaggaaatgttgaagggtaccaagaagccagctgtagggctcccctctctccaattccctcatgcccatgatgtctgaaaagtccaccattcagactctttctgaggagcctaagatgccttgggctccagaggtggtcccctggtctggtgaaacttagcattagctcctgctggctggaatgattgatccagggataggcacagccagtgggaatccttcttagaaagaccttagaacaattagaaaagaccctcctccctttagttggtaataagccaataaaagatcagagacggtgggggtcatctttgccttcatatgaaaagacctcatcgtgcctgtaatcccagcactatgggaggctgaggctggaggacaacttgagcccaggagtttgacaccagcctagaaaacatagcaagactcccatctctacaaaaatttaaaaaatcagctgttcataggacacatttctgtagtcctggctactctgaaggctgagacaggaggattgcttgagcccaggaggttgaggctgcagtgagctatgattgtgccactgtattctagccctggcaacacagcgaaagaccctgccttaaaacaaaaaaaaaagaacagaagtcactggagatgagccaacctgggaaggtagagtccgaagacggagagagggaattctcaaggcccctgtggatcacctgaatccagcccctcacaccctggacccctcctttcagatgccccaaacatcctattgaccccctcccttagggtattttcaaatgttttccttcatttctggaatgttccagcaatactagctaacatgctccactgttagctaataatgccatgagccctgagctcaaagtcctgagctcgaagatctagggaggccttcccaacaccatcccaggcagatcctcctgcctgctggccattcttagcactctctgtatccctttcctatagcattgtccccatttgtaaggacacttgtatgtgtgtatgtgatggtctggttaatgtccttcttccctactagactataagctccccaagggtaaagtctctgtctctgttcatcattctctccccagtgcctctcaaaggcctggcattttgtaggtaaatatttgcaaataaaggaatcagggtctcattttggttgaggtcaactgatcaaagctcagactctaactcagactcctggtttctaagactgactagctgagatcttgggaaagtcacccacacttgtgagcctcagtttcctcatctgtgaaatgggactaataatggtacatcccagggatgctgtaaggattgaatgagctgctatgtgtaaagtactgagaatgagacacagcataaagtcaacatggagcaacagtgagctgtgcttcttataagggcccctttagctgtggctgctactgttgacagtgaaagatccaaccaacgactgatgttttactctgggctttagatttgtcaggatggtgtgttgtctcttgtccccaagccaggtattgaaatgtggggtggggggaacaaaacaactgccaaaactctggagggatgctgggtggttttgtctaggtttggagcccatcacagcccaagaacccctggaccagctatgttcactgaaacatcacatggtatctagagggtccttgaatggcacacttgtcacaactttttgtgctcaaaaacagtcactggaggatcttttaaaagtgcaaattatagatctagagtggggctaatattttgcattgctaacgggtccccaggagatgcctgtgctggtccatggaccacactttgagtaaccaggcagatgtacactgaaaagcaactcccatcgtgccgagaaagctggctggctccagtgacctgaactatttgaaagagtgggtaactgaagaggaaagaaaacagcctgaaatggaaataaatactgtgtaccacaatctcattaatgtctaaaattagattaacataattaaaaatttaaaagctagattaaagcatgtcagcctgaaatccagtggtgaattatgccacagctatctttgctttttccttaacggtttgtgctaatgggtatttcaaagactactgggttacacgttgttctttgtgatttttgattatcaccaaacacatgcaattgacccgatttccaaggagatggctctcccaggacatggctaccatgacactccaaaaatgtaaaatcatgctcaaccttgggccctctcctctgactgccaagtaggcttctttggggaaagaaaagaggcttagttactctccagatggtaggcatgcaccttacatgtgtcatgccagtcatggtgagtggcacaaatattattgaggttcccatttttaatgtattattattattattattcgagatggattttcgctctgtcgcccaggctggagtgcagtggtgtgatctcagcttactgtaacttctcgggtttaagcgattctcctacctcagcctcccgagtagctgggattacatgtgtgtccaccatgcccggctaatttttgtattttcagtagacacgggaatttcaccatgttggccaggctggtctcaaactcctgaccttaaatgatcctcccacctcagcctcccaaagtgctgagattacaggtatgagccaccatgcctggcctgaggttcccattttataagtaaagaaactgaggttcctagaggtacagtaagctgcttgaggtcacatagctaattagtggaagagagctgggatcctaacgcagttccgtttgatttcaaagcatccatattcttttcatggcctctctgaagaataaaccatcacatggttccatttaaggagtgaatgcatatgcacatgtgtgcaggcagaagagtggtgctgccaagagaaatggagacagagtaaacatctaatcataaaatgtctatctctttgtttctgctcaagttgtcatactgaacccattaccactgatataacttactacatatttgaacataattggactaagtgatctgttccctcgccagattcacaaagcacttattagctcaggcttctggtcctggagttattaagtctgttctcatccaccaggagattaggttcctgagggtgaatatcaccttggagacatttcagattgccatgactttaaccctaaaatgggtacggtcgtcttttcctggaataggtggacaaaagaaggcaaagtggggcggggactccgtggagctaggcacgggtcatcatggccatgcgttcatgggatatgtccacacccccgccaagcttctctcttgagtccccagacttgcagtttggccaaaacatctccctataaatctgatttccttccaggaagtgagatattttgaaagagtcttgggagtgaactttgcctaacctaagttacactgggaggatattgttgcaggtaaaggctgcttgctaaagggctgttgctttgaactgcagactgctattctcgtttagttatataagccggagagttatgtctactttggttgttgttgttgagacggagtttcgctcttggtgcccaggctggagtgcagtggcgtgatatcggctcaccacaacctccacctcccaggttcaagcgattctcctgcctcagcctccctagtagctgggattacaggcatgcgccaccacgcccggctaattttgtatttttttagtaaagactgggtttcttcatgttggtcaggctggtttcgaactctcgaactcaggtgatccgcctgcctcggcctcctgaagtgctgggattacaggcatgagccactgcgcctggccctatgtctactactatttttgttttagaagtatttactgaggaccaaatgggtgctggctagtcttctggatgctgagactagagcagtaaacaaaatttggatgctagaggggaatatattaaaaatacagccaaaatgtaaaatggttcagcctctgtggaaaacatatctgtggtttcttaaaaagttaaaccaaattactatatgacccagcaactccattcttcaaagtactgaaaacagatactcaaacaaatggtatacacatgttcacagtggcattattcacaatagcccacaaggtggaaagaattcaaatgtccatcagtagatgaacagatgagcaaaatgctgtatatccctacaatggaatattatttggccatgaacaggaacggcattctgacacatgctacaagatgcatgaaccttgaaaacatcatgctaagtgaaagaagttggatgtaaaaggtcatgtactatataattccatttgtatgaaaatattcagaataggtaaatccgtagagtcagaaagcagattggtggttgctgggagctgatggaggggggatgaggagagaccgtgtcatgggtatggggttttcttctgtaatgatgaaagtgtcttgtaactagatagcagtggtgcgtgtgcaaaattgtgaatggactcaatgccactgaattgtacactgaaaatagttatttttggtaatatgaatatcacttcaatttacaaaaatggagattaataagattatttctgataataagagttaataggaaaattataaagagtaatgaggtgaagggtcaacaggcattgttggtgaaatggtcaaagaggaactccaccagggggcgacactgaggagatattgatgacccatgagagaaaaccttgcaaggactggggcagagctttgcgggcaggaggaagaacaagaacaaaggttgggaggcaggcatgtggtgggccagttggatgccagcatggtgattaaaggtggatgcgacaagagcccataatgtgaggtagacaggagctggatcctggaaacttccctgacaggtcagaaactcgtacaaatatttgaactcagatatcaggggaagccactggagagttacaaccagggaacatatactgatttgcatttttaaaaatcgatgtagggctgggtatggtggctcacgcctataataccagcacttttggaggctgaggcaggggaatcacttgcggtcagaagttctagaccagcctggccaatacggcaaaaccccatctctactaaaaatacaaaaaaattagctgagcatggttgtgggcgcctgtaattccagctactcaggaggctgatgcaggataatcacttgaatctgggaggtggaagttgcaatgagctgaaattgtgccattgcactccagcctgggcaacagagtgagactctatctaaaaaaaacaaaaaacaaaaaaacccaacaaaaacaaattgatgtaaaattcacataacataaaattaaccgtgctgaagtagacaattcagtgggctttagctcattcccagtgttgtgcagctaccccctctcttgttccaggatattttcatcagcccaaaaggagacactgtattcatagtcagtcacctcccattccctgtgccccaaccgacaactaatctgctttccttctctatggatttccatatttggggtgcttttaaagttaattatttatttttgagacagggtctcattccgttgcccaggctggagtgcagtggcatgatgttggcttactgcaacctctgcctcccagcatgcaccaccatgtctggttaatttttttgtagagatgggttttgccatgttgcccaggctagtcttgaactcctgagctcaagtgacccacccacctcgacctcccaaagtgctgggattacaggcgtgcaccaccaggcccagctaattttgtatgataatggaaattttattactctataaaacataccaacaattgagcaaagactgtccaaaaaattgttcccatccccaggactcaaatctccccactatctttcacttcaaaatcagaccacagctgtctttgtacaatttttttccaacatttagaattttaccacatctagaagttctcaggtcaggtgattctttaaacaatcgtgcatctatctgcttgcattgacattcccccgtctacttctgcagatgaagtctcaaccattgtcacctcctccccaggcaatggcagtatgtaggaatgtaaaacggagcagccagtgtggaaaatagttcagcggtttcccaaaaagttaaagaatgatcacagagcctagcaattctgctcccaagtagatgcccaaaggaattgaaaacaagtgttcaaacaaatactcttacaaaaatgttcacgacagcactagttataaaggccaaaaggtggaaacaacccaaatgtccatcaacagacgaatggataaagaaaatatggtatatcgatacaatggaatattattccaccataaaaaggaacaataaactgatacatgcttcaatgtgggtgaaccttgacaacagtctgctaatggaaagatctcagacacaaagtcatatatggtatgatgccatttatataaaacatccaggccaggcagaccactccatctcaaaaaaaaaaaaagaaagaataaaaaagaaaatttccttgccagctagcttgaaaatctctcttggggcccaaattggccttgtttaggaagacactttgatgagtatctgggaggaaaatgaaaccctgaagtcatctgtcaattaaaaccaaagtccaggaaaatcaagttttaaaggtattccagaatttcccgtagtatggaggaaagaaagagacaggaggtgagagaggcatccagtgacaaaatgtggctgcctgagggtcattagctagtgaagaatttctggtgaactttgttgaatcctctggcttcaatcctttccctgtgagaaggtggggaaactcagtcccagagcagcaaaatgcttgcaaaaagaggataatggcaagcagggtgcagtggctcacgcctgtaatcccagcactttgggaggccgtggcaggcggatcatgaggtcaagagatagagaccatcctggccaacatggtgaaaccccatctctactaaaaatacaaaaattagctggatgtggtggcacgtgcctgtagtcccagctactcaggaaactggggcaggagaatcgcttgaacccaggaggcagaggttgcagtgagccgaaatcgtgccactgcaccctagcctgacgacaaagtgagactgtctcaaaaaaaaaaaaaaaagaggtaatggcaaaaacaaaaatcaaatgtgctttctacttttctcctgctatagaatgtttctgaagcacttctctaaggagagacaaatgaatgcccaagctatactctctataaatttacacttacatgaaaggaagaagtcatcccttcattcatccatctatccacccatccacccatcaatccattgatatatcagtttgtctgtccatccattcatcttcctatccatctttccttctatccatccatccatccgtccgtccgtccgaccgtccgtccgtccgtccgtccatccatccatccatccatccatccatctgtccatccatccaaccatccatccatttcatcaattaacaaatattttagcacttaatgagctgaagtcagggattttcattgcaggcctataggccatgaccaaacatttgaattttattctaacagtaatgaggttttatgtaagggttttaacctggggctagcttcatcttatttaagttataatgattactttggaatatggaagatggactggagggagcaaaagcagaaattgaaagatgtatcatctaaataacacagtccaacaatcctattgccttcaatcacatgggcttctgtgcaattcaacaggcaccttttacaattttttcaatagatttttggcgaacaggtagcgtttggttacacgaataaatactttagtggtgatttctgagattttggtatacccattacccaagcagtgtgcactgtacccaatgtgtagccttttatccgtcacccccaacaccctttccctgagtccccaaaattcattgtatcattattatgcctttgcatcctcatagcttagctcccacttatgagtgagaacatacaatgtttggttttccattcctgagttacttcacttagaataatggtctccaatcccatccaggttgctgtgaataccatcatttcattcatttttactgctgagtagtattccatggcttgtatatatatcacaatttctttctatatcacaatttatttatccacttgttgattgatgggcatttggactggttccatatttttgcaatggcgaattgaaacagacacttattgagctgctactgaataccaggcccagtcaatctgggtgcagggatgaccactgaatgtttccttccctcattggagctgatactacagtggtggatggagagaagaaagctgacaattgtgaccaggatgggacagcagatacacagatgccaagacagtaagggtggaggccttgacaaagtctaataaaggcagaggtaagccctccaaggggggcttcttggaggaattggtatttaagctgaggatataaggatgcctgggacttggctgggaagtgtactcttagcaaagaaaacagggtgagtgaaggcacaaagcatgacactgcagagtttcacgtgggaagccacaagagcccttcaggaatgaggcagaatactacatgggtatgtgcgtggaggggttgtgggcaggcgtggtgacagctgacaactggggtcactatgagtagaaaatgagactcgagataccagtggaggctaagtcatgacagatcatatgtagattacatcctgatggtactggggaggtactgattataaaaaggagagggtataaatcccccttcctttgcttctttctgagtacagagccatggtctgagcacatctggatgagaaagaacgtttgaaggctgagcccttaggaagcaaattccatatgccatttgttggtataagatgtttatgtggggaacatattttcaggtgcaattatttctcttgcaaaaacatgacctgtttctcctattatacttatcatctatttattttgaagagtgagaaaacagactttaaaaatgaacaaaaatttaaacctgcaattttttcatctagtgataactgttactattttattgtatgatctgtcatttaaaattacataatcacgacttttctataaatgggatcatagcctgcacactgctttattagttgcttttttagttggaaatacagcatcaacagcctctgtgttttcttccaagggctgccaaaacaaagtgaatggcttaaaacaatagacatgtattataggtttagaggctagaagtccaaaatcaaggtgcttgcagggccaccttccttctaaatcccataggagaatccttcctggcctctttctggcttatggtggtcactggtaatctttggcgccccttggcttacagttgcataaccccagtttcagcctttgtcacttgacattctccctgtggctctctgtcctcacatggttgtcttcccatgggacaccttttgtgatggttcatgctgcatatcaacttgattagattgagggatacaaagtattaaccctgggtgtgtctgtgtgggtgctgccaaaaaagattaacatttgagtcaaggggctggggaaggcagacccacccttaatctggtgggcaccatctatcagcttccagggaatacaaagtaggcagaaaaacttgaaaaggagagactggtccagcctcccagcctacatctttctcccgtgctggatgcttcctgccatcgagcatcagactccaagttcttccgttttgggactcaaactagctctccttgctcctcagcctgcaggcagcctattgtgggaccttgtgattgtgcaagttaatatttaataaactcccctttatatatatttatatgtgtatatatatgtgtgtgtatatatgtgtgtgtgtatgtatatatatatctcaaaaagttaaagaatgatcacagagcctagcaattctgctcccaagtagatgcccaaaggaattgaaaacaagtgttcaaacgaatactcttacaaaaatgttcatgacagcactagttataaaggccaaaaggtggaaacaacccaaacgtccatcaattatatatatatatatatatacacacacatatcctattagttctgtccctctaagagaaccctaatacacctttcatattggactaggggcccaccttactccagaaatatctcgtcttcactaaacatctgcagccaccctatttccaaggaaggtcacattttgaagtactaggggttaggactttgtgaaaggaaagtaccttgggcccccaaaatcgctaagctaaaaggaaaattcaagctggaaactgctgagggcaaacctgcctcccattttattcaaagtcatctctgtgctcactgagatagatacatattctgattgcctcctttggaaaggcttatcagaaactcgaaaggatgcaaccatttgtctctcacctacctgtgacctggaagccccctccctgatttgagttgtccctttgtccccgcctttctggacagaaccaacgtacttcttacatatattgactgatgtctcacgtctccctaaaatgtataaaaccaagctgtgccccgaccagcctgggcacatgtcgtcaggactgcctgaggctgtgtcacgggcacgtcctcaaccttggtaaaatacactttcaaaattaactgaggcctgtctcaaatttttggggttcacaacttcgactttttttttttttgagatggagtctcgccttgtcatccaggctggagtgcagtggcacgatctcagctcactgcaacctccacctgctgggttcaggcaattctgcctcagccccctgagtagctggggctacagacacacaccacaaggcctggcaaattttttttttttttttttttttttttagtagagaagggatttcaccatgttggtcaggctggtcttgaactgctgactttgtgatccgcccacctcagcctctcaaagtgctgggattacaggtgtgaggcaccacacccagaggacatatcttttttttttgatgggggagactcggtgtaactcataacagcctcacttgccatctaacactatttttactggctacacactattacattttgtaaatgtacaaatgtccctgggtccatctttgtcacactgaacaagcaatctgctgcgtgtccttgtcctgccgtgtgtggtgacagcagccatcagcctgagcactgtgatgctgggtaccttccaaactcacccaatcttccgctccctgctagttgctactgacagaaaaagacggtggactcaagttctctgaaaatcctttcaaacacaagggcaagagcaaaaaggaaaacttcacataaccagaagagtcaatggatcagaatttcccccaggcattctggttcatgcagatttgaccacattttggaacaaaaccagttctaagtggtctactcatcagttgctcacctgaatgcaacaattactattattattttttgagacagagtctcgctctgtcaccaggctggagtgcagtggcacaatctcagctcactgcaacttcacctcctgggttcaagcgattctcctgcctcagcctcccgagcagctgggattataggcacacgtcattaggcccagctaatttttgtatgtttagtagagacggggtttcactatgttggccaggatggtcttgatctcctggccttgtaatctgcccgccttggcctcccaaagcgctgggattataggcatgagccaccacacccggccataacaattattttattcaacctgccttatgaatgtaggcaaaaagcatccaactccagtttcccaggatatcactcattatcccaaaagatgtggcagcagcctagaaagcaagtctgttttaaaccataaaacctcccctttgtgagcaggagaccttccgcaccacgtcttcacacacacatggagcaacagtactttgtgttgcctgttgcggctgtaaagaggttttcatgcacactggcccatttgattatctaagcagtccagctggaaggtcaggaccattcatacctgaggctttggaacatcctgacttgcccaaacctgctcagcttataaccgccaccaccacaaatcaggaattcagccatgtgtggatagacagtcttattcaatcttccccaaaacataagaaagtgctgtgttcttttcccttctagagaaaaataaactaacccttaggaaacacgctacctgacccatgctcagacagttagacagtactggaactgggtcttgaacccacactgcctccctccccaggccatgtttgtaaccacaaagctaacttgtgctgggctaagacagacttttaactccttgaatcttgactctttttgccgcatgacctggtttggttcaacaatggcaatttatctctatttaaaagcagatgttgggacgggcatggtggctcacgtctgtaatcccagcactttgggaggctgaggaaggtgggtcacctgaggttaggggtttgagaccagcctgaccaacatggggaaaccccgtctccactaaaaatacaagaattagatgggcgtggtggcgggcacctgtaatcccagctactcgggaggctgaggcaggagaatagcttgaactcagtgggaggaggttgcagtgagccaagatcatgccggtacactccagcctggttgacagaacaaaactccttctcaaaaaaaaaaaggaatggatgctggctgggtacactggctcacacctgtaatcccagcactttgggaggccaaggcgggcggatcacttgaggtcaggagattgagaccatcctggctaacaaagcgaaaccctgtctccactaaaaatacaaaaaattacccaggcgtggtggcacacgcctgcagtcctagctactcaggagctactgaagcaggagaatcactcgaacctgggaggcggaggttgcagtgagccagatggccccactgcactccagtctgggtgacagacgtagactctgtcaaaaacagaacaaaacaacaaaaatgatcttttaaagttacttactatctaggatacctgctaggctgtaggctccgtctggaagtgtgtgacaacttaggtccttgataagtatttgccaagaaggagaagggatgggtagatgggctgggctgtctgcaaagttgaagctcaccagaccccagcttccttccttctgggatgcatgaaacagagaagtgtcaaaatgtccagcaaggtaaatgacttcctgctccaaagcatggaaggctcattttcaccccacttagcagtgaattatgttacctgctggtgaggacaactccaggaggcccgtaattagttccctgattattcacaattgaagcgatcacggctaactgatggtgttcccacaaaaacctgtaggagagccaggccatttggcagcaactgcgttcccaacaaggcagatcaatttccgtttgatttgtttaaaaataacagataaacaatgcggagcagctcgcaaggtttgggttcctcctttcctaaaatttgaggaaaggaggccgtttgaaattaccagttaggaataaaacaggcagatcacattcgtggctcaatcggattcccctataatcagagctaataactgtatttttctgctactaaacaattctgttattttaaagctaactataccgagctggctaaataatactcaggggctggccacagagaagactccctctgaaatgcagcgatgatgcccactttttcctactttgttctaattttgtccccagctgatgggtgacctgctgactcttgctgggagagaggctggagggatgtccagggagattttttaagaaacctagaatctcacacctttccctggaatacaaagggaaccaacccatgtttccttgaggataatgaattttaaaggcttctcgacctggattcactcataatctgagctcttccttgacctctgctattttccaaatatctaaattccgtccctttctcagctaagtccttcaatgacttcccactgccattaagatatgcctaagccacttaggtggctggcatggccctgtctgccggtccctcacctacttctctggccccaaattcctccatccacccgcaactccctttccttcatgttcccactacactgaattatgatctgcatggagcagcatgatagaggctatggactctagcagccagggtgcctgcttctaactctagctccaccattcatcagctgtgtgacctggggcaagtcatgtgacctctttgggcctcagtggccacatcgataacatgggaatcatagaagtacttgccctgtaatgtagctgtgaccatagatgcattaatgactgcatggtgctgagatggtggttggtgcaagcccgtgtgcctggcagagattggtcgtttgtactactttttgtttgtttgttttgttttttggagacggagtttcactcttgtcacccaggatggagtgcaatggtatgatctcggctcactgcaacctccacctcctgagttcaagtgattctcctgcctcagcctcccaagtagctgggattacaggcacccaccaccatggttggctaatttttgttttttagtagagacagggttttgccatgttggccaggctggtctcgaactcctgacctcaggtgatctgtccgccccagcctcccaaaatgctgggattacaggcctgagccactgcccccagccagcactactcttcaaaggtgcttttttttttcctctttgcatatgtggtttccgttgtcaggattactctttctgtctctaattctttgctttcttatttgactcatcttttggtatttagcttagacgtgacctctgcctggaatccttccagatgccatagccttcctctggagccaagagcatcctcaacttcctccatcatagacatctccccctgtggattgtaattacatatttgtgtgtgtcttatcgccaccaccagggtttctcagcctcagcactactgatctatcgacatttggggccagattattcttggttgtggggggccatcctgtgcactctgtgatgttcagcaccacccctggcctctacgcactagatgatggcagcagccctcctcaacccctagttgtgactatcaaaaatgtctccagacatggcctagtgtccctgggtatgggcagatatgaaattgctcctggttgagaccactacactaaaccataagctgaggggacaggaaatgtgtctgtctttctcatcccaattctctaagcacctagaatagccccaagtgattatttggtctttaattaatgtctgcggaacagaagaatgtggattctggggccaggagcggtggctgatgcctgtaatcctgcactttgggaggctgaggtggaaggatcaccgaaggtcaggagttcgagaccagtccagccaacatggtgaaaccccgtctctgctaaaaaaaaatacaaaaaattagccaggcatggtggcacatgcctgtaatcccagttacttgggaggctgaggcaggagaatcgcttgaacccgggaggcggaggttgcggtgagctgagatagatagtgcaatagcactccagcctggacaatgaagagcgaaactccatctcaaaaaaaaaaaaaaaaaaaaaaaaaaaaaaaaaaggagattctacactgagcagcaaagcaaatcaggtcaaagtgaaaagacctgagttcccctcctggatgtgccagtccctggctgcatgacttggagaggcccaagtttggttctttgaagtgacttgaatgagcatccttgtgtggtcacagacagcagcatcagcatcacctgggaatttgctagaaatgctcattctctggatcccccagaccagtgaatcagaattgcagggaggagctctgaaatttgtgttttcacaagctctctaggagtttctgattcatccttcctcagttctcagatcacccctggccaatcttagaattcacctggaatgctttttaataaaggatgcttaggaggctagattttcccggtccaagtgcataagaagctctggcattcaggctggccatcggtgtttttcacctgcttcaggtgattccaatgcacacacagccaggactgagatgttctcgacgcgcagaggctgttctaaatctctgtgcttcccacgttaaagcttttgggaactgcattaactctttcagtccaccagagggccatttacagtgctaggaaagggacagggttatcatttcatgtcctggggcacatggagccatagaccataagtacacaggtagaagtaagtgtccaagaccttcctctctagctgtacctggaaaaataccagaccggaatgtgaagcatcagaaatgactctaaggcttgactcatgctcttgcaataaccctgggacagccaagaggaacaggccaacctcaaccaggattctctatttaacccactagttttaaaagccatgtccaagaatcctctctataaattcatttttgaagccctccgtgtccctgggttcatgaaagcttttttgttcagaaggtggctgcagtttattatacagagtagatgcgaagccagacatacctgtgtttctgagaacctgtttccctcctctggatctcagattttattattttagttttttgagacagagtctcactctgttgcccaggttggagtgcaatggcatgatctcggctcactgcaacctccacctccgggttcaagtgattctcgtgcctcagcctcccggagtagctgagattacatgtgcctgacactacacttggctaatttttgtatttttagtagagatggggtttcaccatgttggccagactggtctcaaactcctgaccttagttgatccacccacctcggcctcccaaagtgctgggattacaggcgtgaaccaccgcgcccagcctggacctcagattttaaatgagggtaatgaagcttagctggctaggctgcgatgaggttcaacataggtgaacaggtgaaacaccagcctcaaacagtcgcttagtaactctgtggttctcaaaagcaccctgggatgtggttctcaaaagcaccctgagatgcggttctcaaaagcaccccgacaccagcagcttcgtcaggaagcttgctagaactgcacattttcagatgtctcctgccctacccccgccgcaagaaaaatactgaattggaaactttgggggtggaataacttagcctctctgagtctcaattttctcatttttgaaaccagaataacagtacctgcatctcagagacccactgtaagggttaaatgagctatgtacatcaacttcttagcacagtgctggcatacagcaagagctcagtaaatggtagctttcactgttattgcaattattatcatcttcaaagctccctgccccatgcaagccttagaaagaatctttcgtcagaactctgcacaagtatctcttattgaactttgcaaaataccgtattttggctctgaatgctccctgtggactacaacttgcagagcaggagctcagtacaccaatatgccctgtgaatacctcagccaacattataactcattctgagagatgccatctgtgttagtccgttttcacactgctataaagaacttctctgagactgggtcatttataaaggaaagaggtttaactgactcagttctgcatggttcggaggcctcaggaaacttacaatcatggcagaagaggaagcaggcactttcttcacaaggcggctggagagagaggaagaagcacaaaggactaacttccaaactcttataaaaccatcagatctcatgagacctcactcactattatgagaacggcatgtgggagattgcccccgtgatccagtcacctccttctcttgacatgtggggattaccagtccccctcttgactcgtgggggttacaagttgaaatgagatttgggtggggacagagccaaaccatatcaccatcgctcggagcaatacaactatttactgtagggtcgcattatggattgtgatctatttagttctaccccgctgtcagaaagactggctttccctccaccaaccaggaacaagcgaatgggcttggggcaaggaaaagaacaacaaacaaacagcaaataggacctgaaaaatattacactcatggtcagagaaaatgaaaaagatactgcaggagggaaactgagtcagctctgagtggccttgcggcagtgacagagaactttccagacgaatccatggaggcagaggggtgtctgatatttgcatctgccagctgtcagaaagagctggattttcaaggtggaagagagataagtggaaggtgggattgaaatttaccttcatgcaggtttcagtaatcagggtgagaagtagagaatcctcagctgaagatagttactttctgcaaaagtgggctttcctttctttctcttttcttgtaagggattattttcctgctcagtctcctgagtctcccccagtggccccagcatctatgacccaccattccctgagggcttaactggtcattagctaaaaagaagttgaatgaaggtggggctctctgcagttattaagggttgagaatgcaaatgccatgagagggaagaatttatctgaaacatatgagcaacagcaaacaacggacactgaggactaaggaatgcatgcctcaattaaaagcatttacattgaaacgcaaaattaaagccaattacattgataaaactaatgaaatatggtattaatacataacacacttattgcctgtgtgacttaactgtgtaataacaataagaatggcagcataggactagattccagttgctgtggcctcaaaagggacggatttgatcgtacttgttcccacttcctggaaaatagtggcttttcatgatctggcagctgaagcagcagcaccatgctgctgtaagtgctgctgatggggatttattcaaatgtgaattagacgaagctggtttggacaggcgatgagtcggggaacgctgggacatcctccctgtgacaaagtcctttcacaagcaaagactccccagcccaacagtgatccctgggtgtttcaagaaatccattcagcctgaagtctgaatgccagctctgctacttttagctgcatgatcttgaacttgttctgaatggctctgactcagtttccccatgtggaacattgggaagattacacttacctcttggaattgccatgaatcaaagacattgttgactaagtgtccagcagtgtacccggcacacagtagactttcaaccaatagttcttattgatagtattattatcatttattactgctactaccactacatccctccaaaaattgatccaggatgggtgtgtcaaatggcagggtaaattattgttaagaatggaggaacagcagactacagaattttaggagaatgtattattcttaggagatgcatgctgagttatcaggggtgaagcatcatgatatatgaaatttactttcaaatggttcagaagaacattgtgtgtgtgtgtgtgtgtgtgtgtgtgtgtgtgtgtgtgtgtgtgtagagagagagagagagagagctcctgagagagcagaaattgctgtgtcaacaattttgaatctaaggcaaaagatacgcagatggtcattatactatactattctttcagcctttgtctggagccaggcttcctacgttcaaatcttcactctctcacttactagctatatgataacttctggcaaattaaagaaacactcagtgcctcagtttcaccatcttaagatgagaatcattaaaatgcctaactcaaagggcttttgtgaggacgaaatgagttaatgtacttagaatcatttattgaattaggtgctcaatgtgtgctaactccataattagctgtttgtgattagatacatgtataaatagatgggttgatagaggtggataataagatggggagaggaaggagggagaaaaaagtggaaggaaaggagggaggaaggaaggaaggaatgaaggaaggaagtaaggagggagggaggaaggaaggaaaggagggaggaaggaaggaaggaaaggagagacagctggaatatctcatcactcatagtgagtaatgttttatttgtagttttcagtaaacttcaagtttctgcacttggcataaatgaggtaaacattatcaatgaggtaaacgttattacaaacatatatgtaaattatataatgcccctacccaggttccagcctgcaaacccagctagaagacgttgttctttccacacaggtgttcatcactccttgcgggcatgggcaggagcttggaacagcagagtttttgagacctggagtgatcccctggcacccagagtagaggtgcccttgcttcccttccgtctgctccttctcacctgccctccaaagtcaatttcagtgccatctcactgtcagtggtgcccttgtggatacgggagtcctgttcggccgaggatggagtctccctaatggtaatgcatgcagaataggactggcacctggattgcattttaaacacattccgcaccattaggccatcctcatcattcacaggactgacggcagagttgcgggggcctccaggcccagcagcaagtccagccggttcatccggtcggggcatcctgccaagacccttcagctgtgaagcggccactctaggcacaggtggggagacctgatgagcagaaagcagcctggagtctgcctcctgggaatgggaacaaggattagggggccaagccctgaggagcatcccagccactctcctgggggcacagattctacccattggaataataagtgctttctttttcacgcgcctctctccaacttgctctagcactgcagccactctaaccttattttcctttctccaacacacctggaactttctttacatgggaccttgacacaggcaaatccttctctccagaacattcttccttctgctggttcccttcttgctgtccaactcacctccccaggaagccctcctagatctcataatatcataatatcaagaggttgtccctgcctcattgtcttttaccttttatttacttatttatttagagacagagtcttgccctgctgcccaggctggagtgcagtggtgcaatcttggcttactgcaacctccgcctcccaggttcaagcgattctcgtgcctcagcctcacgagtagcaccgtgcccagctactttttgtagttttagtagagataggttttcaccatgttggccaggctggtcttaaactcctggcctcaagtgatctgcctgcctgggcctcccaaagcgctgggattacaggcgtgagccactgcacctggtcttttatcttgatactttctttcttttcctctgtgcctcagcttcctcctttgtaagtggggtaacaattgtgcggaatgtgctctatttggtcaacttttctaccatgttctacattcctttggctgatcagttggttctcatgtcctctgtctggattcagtcaatgagaggcaggcagagaggagatgggactattgattgatcccctgggcttacatgcttacctgttgggtggcgctgagttcctcttttcaagctttctgatggacagctgtgttcttggctctattaggttggtgcaaaggtaattgtggtctttgccattactttattttttttgagaaagagtttcactctgtcgcccaggctggagtgcagtggtgtgatctcagctcactgcaacctctgcctcctgggttcaagtgattctcctccctctagagtagctgggactacaggcacccaggatgcactcggctaatttttgtatttttagtagagatggggtttcgcatgttggccagcctggtctggaactcctgacctcagatgatccacccgcctcggcctcccaaagtgctgggattacaggcgtgagccaccgtgcctggcctttggccattacttttaatgaaagcgtccctccggtgttccttcagcaccaagggtggtaacagctccctgatgtggccagcgcctcggtgcttcactgtcccttgttggtttccttgggtcctgcccacacctttgtaaattgtcccttcgctgcactagcctcagtaatggctcagacagtgtcatctgctacctaccaggactctgatccacataataatagtccctatctcatatgttgtgaggattaaaatgatttcagtgcaggatacacagtgctaagattattatttgctattattctccttcctctcacttatcacactttgcacttagttgcaatgctaattgctcactacttttccctctggttaattgacaatttgcatgaagagggagtctctgtctgtgcctgttcattcaatctcgtgatggtccagtgttagatgcaaaataggtcctcagaaaatatctgatgagtgaataaatgaatgaatgaaagaatgagggttggttttcactttccaaagcacttttatatatcatgttgaattgtgtggtagcatgcatattcgattggttttgtttgataaacacagtaatttcacaagcctttacctattacattatcctctttgatccatgaagaatagtcacaatttaataaataattagactgagaagaatggagggaaaagtagaagggggaaatgctgcctgagaacctattatgtgctcagattttccattagcatttgatggacatgatttattttgattttcacaatggttattatcataacgacagaagcatcattattccctagtttacatatgcagaacacaggacagagaacagttggaagactcacccgtagttactgtattagtcagggttctctaatgggaccgaactaacaggatagatgtatatataaaggggagtcgattaaggagtattgactcacacaatcaccaggtgcgctctcacaataggccatctgcaagctgaggagcaaggaagccagtccaagctccaaaacaacaaaaggagggaagcccacagtgcagccttcagtcagtggtcaaaggtccaagagtcccacagctgaagaacctggaatccgatgttccagggcaggaagcatccagaaagggagaaagatggaggctgggagactcagccagtctattctctccatgttcttcaacctgcttttattctggccgcgttggcagctgattagatggtgccctcccagattgagggtgggtctgcctttcccagtccagtgactcacatctcctttggcagcaccctcacaggcacacccaggaacaatactttgcatccttcaatccaatcaagttgacaatattaaccatcagagtcaccaagctggagggtcatagaactggactccagacctcatgtgtttcactcaaaatgtcatgcttttcccacacagcagttatcccactgagagaccccagagagtctcttataatgcatgcagggaaaggtataaacaagtatctgtttgtaatagcaaaacaaatggcagcaaccccacgtgtctattgggggagaaagggtaaataaattgaaacatttaaacactgaaatagtgtggccataaatgtgaatgaactagaggtgcacatatcacctgcaataagtgtgaaggaaaaaacaaattgccagaaaattccttagtgtaataccattttatatcaaggtttacaaatatacaaaacactgctatggttgggagtggtggctcatgcctgtaattcccacactttgggaggctgacgcaggcaaatcgtttgaacccaggggtttgagaccagcctgggctacacggtgaaaccctgtctctacaaaaaatacaaaaaaaattagccgggcatggtggtgcatgcctgtggtcccaactgctcagaaggctgaagtgggaggatcgattgagcccaggagatcaagactgcagtgagctgagatgacaccactgtactccagcccgggcaacagacggagcccccatctcaaaacaaaagcaaaaacaaacacaaagcactactgtgctttatttaaggatacaactatgtcattacaaagtgctcacattcaagaaatcacacataccaaattcaaaattgtggtagaagggattggatgatactttaggggagtgacttaggggtctccatggttcctgtgatgcttttcttaagaggggagggggtttgctatattattttatacttttttcttcttaacagaaatgtctcatttataaaaaagtggtaccttgcctaaggacacccagctggttaaggatggagctggacatgtacataagccttgcgactcctggctcagtgctctttcccctgcggtgagctgtccaaaaacggggtaattatctcccttgtgcaacttgggaagaggtgaaacgcaatgttgagtaacccttccttgcttccttccttccctgattacagccttaccaacaccccggataccttctttcaagttgttcatgttgcctgcctctcagagtatagtttggtttctgcacggcttcagtgcaaaaaagagaaacttcctttcattgactcaatcagaaagtctcagaaagatcagagaaagtaaccatcccatcaagaagctggcgtggggccgggcgcggtggctcatgcctgtaatcccaacactttgggaggccgaggcgggccagtcacctgaggtcaggagttcgagaccagcctggtcaacatggtgaaaccctgtcactactaaaaatacaaaaattagccaggcgtggtggcaggcgcctgtagtcccaggtactcggtaggctgaggcaggagaatcgcttgaacctgggaggcggaggttgcagtgagctgagatcatgctactgtactccagcctgggcaaaaaaaaaaaaaaaaaaaaaaaggaagctggcatggcaggcactcttgtctgcctgcttaatgattctatgttagcagggaccgtctcctataatagaagtccgaaaagggggctactcattttcccagcctccccatggcatggccggtaacctcatctccataaagggaaaatctgctgaggggtttctgggaaatacaccccctgttggtaaaaaaggagagatgcaagaaagatgccatctctctttctgctttgtatgttgtcatgcaagaatgtgatgtttggagctgtggcagccaccttgtaaccatgaggaaaggaccaagagaataattaagaagctattgctgacctgttgaataatctcaagccacctatctctcaattgcttcttaagtgagaataaaaatgaatcaatattgtgtatccacttttactctagtgttttcttcctggcaaacaaaatcacatcatctgactctcctaaggaaagaaagataagcaggcctgtggtccaggtacaaaccatctagacacaggcacttacatgccatctgcacacatgtgcttagatgggatctaggataaatagaagtttgccaatcccttgattagcccttgccataacttctacctgttctttggataagagtcaaaatcttcggcaagaccttccaggcctggcccaactggtccctgcctgcttcctgcctcaacctgggccactctccccatatgactcacaaggttcccacacataagtcttgttgttgttttattttggtttggtttctccagtttgccaaaaccttgtcaattcagggcatctgcatcagcttgtccctctgcctcaaaagtgccttccctcactctttgcctggaaaacttattctaaatcttccattcttgccctaacaatgatttcttcagggaaaccttcccattcttgatagattcctaatatttatatatctcataggacgatgttttctccttcatagccctgatcgtctattatattttcttctttttctgtgcatttatgtttctttgaccgtctccaacaatggaatttaattccactggagcagagactgtgttggacttcagtgtccctccactctaacccaaaatatgcaccatcgccctactttctcaaagtgaaggtctgggcagatcacctccattttcaagactagttaagataataaatgtggctgggcgcagtggctcatgcctgtaatctcagcactttgggaggccaaggtagagggattgcctgaggccaggaatttgagaccagcttgagcaacatagtgacactccgtccctacaaaaacatttttaaaaaattagctggatgcggtgttatgtgcctgtagtcccagctacttaagaggctgaggcaggaggattgcttgaacccaggagttcgaggctgcagtgaactatgatcacaccactgcactccagcctgggtgacaaagtgagacactgtctcaaaaaaaaaaagaaaaaagaaagaaatgctagctagtattactattatgtctattcattttctagagttaaatttaaattccttagcctggcatttacggtcacatttaattcatctccttcttcattcattcagcaaatatttattaaacaccaacatgctccaggcactgttctaggcaataacatacctttcctcctttatcttccctccactcctcactaagtcatctgccattcaaaccacctcaacttcattcacattactcaagtttttctctaaaccacatagtaaatactattttttccatatttttcactcaaattctttcttttgcctaaaatgcctttctcactctgtatatttccaataactcctcacctatctttcaaactccaccctcattattttatgcaaaaatatttattaagcaccttttatgcatgtcctggtctcatacatcggattggacatgcaagagaccaggaagtgcatacaaagtgcttaataaatatttttgcaattggagattccctggggggatgggggggatgggagggatgcaggtcacgcgtgtggctcttcactgttcttacgcaatgtctgacgcatagtcagtgcacatggtctgctgaattgtggggaggaaaaaacagcttgagaagcccctttcgctttcaaggcttaaagcctctgagccaagggtctccaaatattttcgatcatgaacacctccctccaaaaaagtgaatgggcaccccagtattagattgattttatatttaaacattgaattatatactcttcatatgataatgcacaagccaaagaaagagactgaaagcatgagattaaagaaagtaaaattcagtagaaattctcacagttttcatccagcatttcttggatcaagttacccatccccattttagagactggtctaacctcagaagataactgactctggctcacatggcggggctaagaggatctttcgggaaaggcaacgcattttcgttgcaatgacagagaagtagttggcctggggcttctacgtctgttgcttcccatgaccctggcatctctgttcattggagcttccttggatcttgccccttgaaactaacagatcagctacttttttcctcctcttccttgcctcatccatgacctggaactgacctcatccatgacctggaattgacctgcctatcattgaaataattgaaattgaattatttccactataatttcattgaaataataagcagcaggctgtaaatccgggttgaacttgagagctggctaggaaggtaccaggcccttctcttgcttggggttttcctgcagatgaagcagcaactttgacttctcaaggtaggcggggaatttctgtgaatgtctcatgcttggagaaagcaaacctgccaggggacgtgtcccaatactgttttcttccgtgcatcacaacaatttatgaagagccacgccatcgccaccctaatcctgctggctccttctcaaggcaaaatgagtttcggctgcttccccaggtgtctctagccccacctctgcaggaagcagcccccttagaaactgcctagccttcatctctgacaccctgtcaaggccagcaccctgagcctggcctgggcacattgtttaggcctagggcttcagcacaaactctttgccaggtgccccctctgggagtggccaggaacttgggagtaaaaccgccagatatcctattaagataaccagttcttttcatgccctgggccctgcatggcagttagggtgaccaatcatcccagtttgcctgagactgtctcagtttagcactgaatgtcccatgtcttgggatattcctcagtccaggaaggactgactacataatttgcagggtccagtgcaaaattaaaatgcagggaccttcttcaaaaatgatgaagattttcaagattgtgacaacagggtgttaaaccaaataaggtgcccttttgaccatggggacctatggacctatgtgtctgcacaagttacacactcatgaagccatccctggtcccaggcaacccatgacagttgctaactctactccctatacagagattcagaaaaaataatgtattgttaattccacgaggttgttggtttcttacagaaacatgtgctgagacaacagctcttgctcccatctttctatcctccccacacctatgccagagctttctgaaatacgaaatcatgccacgccccaacttaaaccctcccgccatcatattctcaaatgtgactaataatagtaatacaaattgcagactcctggtattgacttcagttatttttactatactgttgcttaagtatgtgccaacataaaactcggcgtaaactttgtgtgctaatagctcttatacaatggtaaaaccacacttataaattaaaacgataagactatagaaccaataaaattcaaaggaacaacattcatttaatgggacagatgagttcgttttgccaaaactaaaatgccgctcgcagagtgattatggccttgggttggctgcagcaaagtgggttatttctcatggaggtgcttcttcatgctctggtccccacatggcttagatccttactcgggacccagctgggatatgtttgtttgaacaccatgacctgacactctttgaaccttacttggtacaaaatcaccctctgtagatcaaatccacctccgatcttttcccattaacccatgatgctgaaagacatactaattggcaccaatggtatcataaataaacatgcaagcatgggcattgaaatcgcattgcagtgtcaggttataaataggccacctagataaactaaaaatgcctacattaatttaaaaactatcaatgaaataaaaagaatacaacaataattagcatttgttgagcaactactatgtgacaggcactgttctaagaacttggcttgtgataacttattccatcctcacaactctgtaaggccagcactagtattaatgccatacgacagatgagaaaactgaggctgagagaggttatgttgacttgtcctaagtcactcaccatgtgtgcagaagttttctaagaaaagtcctcaatatgaactcacagacctctgatcaagaatcagggatcttgtgaggttcctgggctccagcctgggatcactagctcacagattgaagttaaagctcccgagtttggcaatagaaggctttcttcatcttgcctattgacttctcacccttttctcattctgatcctcttctcgttgcacctctatacttctgggctatcttgaaactccaagaggacagcaagctctttgacacttttcattaccttcgcttggaagtcttccctctgcctggaatgatcttaccccttcttacctggaaatggactatgtgttcttcaaaatgctcagtggcatctctctagggtgctgttcccaaatacagttgactctggaacaacacaggcttggagtgtgtgcttgaagttcatgtccatttatacttgaattttttcaataaaatttacaccaagtgtgcctgcctcttctgccttcccttccatctcctccacctcttccacttctgccacccaagacagcaggaccaactcctcttcttcttcctgctctttgatttaacgtgaagatgacaaggctgaaaacctttatgatgatccacttccatttaatgagtagtaaatatattttacttatgagtttcttaataaattcttttttctagcttactttattataagcatacagtatataatacatgtaacatataaagtatgtattaattgactatttatgttattggtaaggcttctagtcaacagtaggctattaatagttaagactctgaggagtcaaaaagttacatgtcaaatttcaactgtgtatggggtttgcatccctaatctctgcattgtttaaaggtcagctgtaagttctttgggatcccaccacaccgaagtctcccttctcttctcaaagacatcattatcctcctcacagcctgtgccctggcagccttacagagctgaaccaaccagatccttctcctctcgaggttttaaattaagactctcagagactgcgggaacttgaagtcagaagctatgctgtgataacagctagcacttatttagtgctgacattgtgccggccctgttctgagaccgttgcatatatcaccttatttcaagctcacagcactcctacgcaggatatcgtctccccattttacaggcaagaaagctgacgcacagaaaggaggatgcattctccatggttgtgccaacagtggagcacctgcatgtgaatccagagtccatgccttcagttatgacaccttattgctccagtgattgcaggagaactgggactggggctggtgtaatggcaaaaccacaggcaatctggaaatatacaagatcagaaactgaggagtgggaaaaggagaagctggttcacagtgagtagaacaggccatataggcagacagaagcaaagacaggataaaaaccaaccccaagatgcagagagagtctctgtcctagttggaccaatgccccagccactgctcagccacctgctgtgcatcttatttggagcccaagtctctcatgcaacttttcctttcttttccattgactcgtttttttaaaacctgactcagactgagtgacattttttctttccttatcacctatactaaaaaactccaaccactggaaattcaccagctccgatgtactctaaggccctgctgctatgcatttttgccacacctaaaaggaagctcacctgctgactcaccgagcaataactgggtcctacttacgccgacatttttaagcagaagtgtgcctcgtgcaatacttagaacatatttatactaaaaaattatttgctgtttatttgaaattcaaatttaactggctggtctgtattttatctggtaacccttacctggaattctatgagaaatgcagacacccaggctccaccccagacctaataaaacagaatctgcatttttaacaagatccttgggtgactcatgtgcacaagaaagtttgagaagtctggctaaaagatgaattaaaggcagtccagagacaatacagtagctccttgtccaccagggacccaaacccttcttatctttccattccaatatacttacctcatgctttctacccttaaggtcacttcctggtaaaggttgccagcctaagtctggcctccagatagaagcaaaaagaagatgccaacagacatttcccaaaccccatagaatggcctccactcccatctcattagctgttcctattgcaaggggagctgggagatgtagtttttccgttggacccaggatgcttctgtgacttaagtgtaagtctgtgggattgatattcaacaggaagcaaatctctgccatttcttctccctgagaagaacttggtaaagttaacaagttgtgttcagtttgaccagggggtctgaccaaaccaaagaggcagggaagggcaacaagatgcctgaaataagaagaaagaacaagggagtcctagccgtgttctagacctaggataattatagtactcagctcaacaatagattctatgctttcacagagaagagatattttgggtatattttggctgatgtagaaagctctagcaggcacagataccctaataccatactcgtgttccagagagcaatgactgattgcaggagtactagagttaaaatcttgcaaggtcaaggacaaaacactgttgggtatgctggaccccaaggaagtgcaacttctgttgggatttaggttacaaaggggagtgtggtggaactgcacagaaccagtcttcaacagcgatgtcatgtggctgcaagaagcaatagcaatgacagcgcaatcaaactctagtactctctgctcattgttgaagacacctggttccctttagactacataagccctttaagtgtgaggaccactgaggatggtcctaaatggtgtatcaacatctcgctggtaagaatgttcaaatgtttaattgaaaacaaacatgaggccaggcgctgtggctcatgcctgtaatcccagcactttgggaggcagaagcgggcagatcatgaggtcaggagttcgagaccagcatggccaacatggtgaaactgtctctactaaaaatacaaaaaaattagcctggcctattggcataccaataatcctagctacatgggaggctgcggcaggagaattgcttgaacctggaaggtggaggttgcagtgggctgagatcatgccactgcactccagcctgggtgacagagcaagactgtatcaaaaaaaaaaagaaaagaaaagaaaagaaaactaagatataaatatatttgcactctgagatcaaggagcaaagaaaattatcatggtattagggtgataaagaagatattattggcgaggacaaccttactttcccctcaaatctaaccctccaggtttggttagtccaaacccataactgctcttggatcatctcaaaccagatttctttcaagtaatgccaaactgaattaattctgggtttctagatgtttgttatacaccatgacaaaacccacttccgatgcaagaagtatttttcttcaaatagcagttgagcatggcaagcaagttgtggctggaatcagcctgctccatactgtggggctttattaacaaacagcctttctttaattgacatttctttcaaggcaatttgcagaataaagataaaaattctctgtgccaaattataactcctcctggagggagacacagtggtcccacttattctttcttttgtagggactccagcagacgtgagcctgtaattgtgaaagatggcaagaaatttctgcatcctggcaagggagaggatggccggaatgagaagccacagtgggatgaatttggaggataatccaagcagtgtcagtgagaagagggaggctccagccttgttgcaggtcaactgccaggtgagccaaaaactcaaaaaccaaaccaaaccaaaacaaagctacaaagcaaaaaatgctctctctctttgcctatagaatgaatacttagaagagagaggagaaggagaattaaaaggaaagggatggaaggaagaagagttattggatctaagggactgaaatatatcaacgaattgtgcaaaatccattctaggtgttcaatgtcagttactcatctgttgcatgtggtttcaatttccttttaaatccatatgtatttgaaatgaagccagaccagggtaggatgaaggggagcctgcatctcactgcttccctcaaaacaaagttttggatgtttttggtcattccctctgggttctcagtgcctggtggattccatcgacaatggatgttaaatccatcctctggggaaaggaagtgcttgcagatattgaacgtggacctcagagtctctaatgtgatgagagattgcaaccaactggcttctgccttttaagaggccctgaatccaggccgtctggaaattaaatagggagcccagctcactgctacagcttgtcagtgtgattgccacccacgattggctctgagcatctcttctaaaacatgccagcaactgtgtctttattttgttgatgcaagtccagatgctggtttgaaggaggtaagctttgtttctgagcccctatagcgcactcttcacagcattcagaaagagaaccaatgccttgggtgtgatctccatgaccctgcatgacccaaccccttcatcacctttctgacctcacctccccaacgttccctccattccaacccctctggcctcctcataatcccttgaacatagcagacagtctcccacctcagggtctctgaacttactgtttcctctgcttgaaattctcctcctgcagatacatgcacatcctcagatctcacctcgaaaattaccttccctggcagccctacatttttaaactgcccatggcttcctagctccctggtctactttactttcttcccgcctaagcatttattcctactgaatgcagtatataagttactggtttatcttgtgccttatctgtctgtctctaattacaatgaatgctccatgaaggcagagctttggtctattccattctgtactcaatccccagtgcctaggacagagcctgggatatggcaggcccatcacaaacatgtgttaaatgaactgataaagtaataaacagaaatgtgcatttggcaatttgaaaagctgaaagtgtggcatagtctaagttgggcaatctatggagaattggggctaaagttaactcggtttcatttccataaggaccccctaccccaccctgtacctgttataataggcccacactcgtttacaaggaagccggtgccaggagctccctggggatgggatgcctgtctcctgttaggtggcagcttgaccaaagccacagatggtgccccagggccatttgcatcaacctggcattcaaggccctgcccagcctgacatggatcagcctttatagctatgtttccaatagtcttccattttgtattcattcacccaacaacatgtgtccagttttatcttaaatcattccaatttgcattcaaccccattagatagtcttgcttgggagaatagtaaaagaacatttttgtttttgcaactcttttagctcaactttgtggtcaggaagttccacagattcacgggttcagctttccctctccagggctttctctacatcaagggcccttgagtcaactaagaatgactgagttttctttgatggcatttgttcaacatcacgcaaagcataatcctggagtccagtagaagaagtagtatctagcctgtcatttaacccacaatgcataattggtatatccaccatataaacacattaacacatacccaaatataacacacagatatgcaaaagcaaacacatacaatgtaagaaataaacatgtaaacacacacacaactgtagacacatatgagtcaaacacctgtaaacaaaatttcttgatctaaattcagtgaagctttccatgttgtttagactgtcctggaagataacactgaaaggcaccaacagcttctgcttaagggatgagatgtggattctttaccctaataggtagttcttttcctttttctttccttagaattggctgttttgaccaatcaaactcttggcttggttttgtgttgaaatgatcatagctcaaccttagaccaggctgttctgatatgcccttactttatcaaattgttagctaaggattattatagagattcttttaaggagaagtgtttgcattgggcatgtgctgcgggtatgctgggaaataagtatattctgggctctgctttgagaagcaaaaggtgatcataggtggggaaaaatcaaaggaggaacattctataatcctttttatttttttgatccttgaactccttgaaactgggataaatgttctaagggcagttcccctgatagtacaaaattaccataactgatctcacaaaggaagataaataagaaaacacatttgtttcaagggagccagggagaaggtatctttttaccttctttctctctctagcctgttgtattctccccctgttctagctgtttcttgctggaaacaatctcaaaaaggctttctctatccagtatggaatgatttatcttagtcttggaattctgggataaaatgtgcatatatgcatacatgtgtacacacacacatacgcacatacacacatgggacctaaagtttcaggaaaggtttttattttattttttaaatgaaaagcaatgtgacactactttcaaactggtttataagaggcacatcaatccagttgtgaactgagaactttttaagggaaggagaaattgttcccgttaagccctaaaacagtattctttcccattgatcatctaaaccaatttgctttatattgaatagctgtattaggaaaaaaaagtcagctgttgataccctccaatgtcagctagatggatttttttccctcaacataaggtgcagttgtagttttcctcaatctcataattaaaaaaaggtgataagctatttgttctgaatcaattcacttagattttaaggagcataatggaacgtctgttgttcctgaaataaacagcacaatctcgagtactcagacagcttgcctaaggtggtaggaatactatgtttttgtcctaccaaggttctttacccggggctccctgacccagaagacctgtgcataaaattcagggctgtgtgacttggatggggaaaatgtgcatatcagttttaactaatttccacctcaaatgcagcgtttcagttaattatgaatataagcaaaattgacagcaatattaatgactttgcacctatggtaaccacagatagtttatgttagattacagacttcttttgtaaaatcggatatagtctatttcacatgcatttagaaacatcattttaagaagggggtccttgggcttcctcagactgcaaaagtcaccatgaccctgtaagtgttaagaccccttctccaggagacctgggtcattagtaaaggtcatgatccagcacaggctgtgaaggtgcatggcatcccatcaccaggaaactctttttttgtcgggggccttgaaccttctcactcatccagcaaaatgctcactctaatgccccagggtggaatctgtcattactgtatgtatttaagcttcttcagattagcggcagaggtgaaggagaaagaggaaaaagagatcacataccactcctccatctcttcacatattttaatttaaatatggaatcatactctatgtcagtattttgtaaacttttcttttctgtttttgaaacagggtcttgctctgttgcccaagctggagtgcagtggtgcaatcatagctcacagcaacctctctctcccaggttcaaggggtcctcttacctcagcctcccaagtagctgggacaacagacgtgtgccatcacatccagctaatatttgtatgattatgattatgatttctttatagagatggggactcatcaggctggtctcaaactcctgggctcaagtgatcctcccacctaggcctcccaaagtgttgggattagaggagtgagccaccacgcccagcctgaaatctttttcttcctaattttttaattttttgagacagagtctccctctgttgcccaggctggagtgcagtggtgtgatcttgactcactgcaacctccacctcctgggttcaagccattctcctgcctcagcctcccgaatagctgggattacagttacgcaccactatgcctggctaatttttatatttttactagagacagggtttcaccatgttggccaggatggtctcaaactcctgacttcaagtgatctgcccacctcagcctcccaaagtgttgggattataggtgtgagccactgtgcccagcctgtaatctttttcttcttaatattttgatagcacaccttgatggagctctttctgtgtcccaagcaacattctaagcgcttggcctgtgttatctcatttccttctcacaaccactcttggcagggggtactcttctgacctctcataaatgttggctaaatgaataatagctgtctcttattgaagacttaccatgtgccaggagctattctcagagttctgtacatggtctcatctattcttccccaaagcccacagctaggttttattatttttacattttatagataagggaactgaggcacagagagattaagcaccttgcccaagatcacacagctggtaggtcaccagtagaaacctctggatatcagtggagacagtctgactgcagagaggtgttgttaaccagcaggcagtcccaccctctatgatgaacttttgtcatggtgattgtttgagcatgctttagtttgtaaggttgccacatcattcctggaataggagatagctttttctttcgcatagatggatactgaaatcactctatatcagtattttgaaaaattttggtgactctaccctcaccatagcatcatttcttgagaaaaagaagagaaataaacgaagcagcagcacgagcagtttctcttcctactggtctgtaatctggccacgactttaggctgtggctgaaattcctgaccttaaattccagcagcctctgattgagggcacccactcagtcaagctcccttcttggaaacagtcaaacgccatctagtgactgaatgcagaatcgcatactcctttcagccaggaagggagaccatggagggggagccaggctgggtcaggaagaggaaaccctctctgggctggtaaagttgaaagcaaggaaatcactgagccccgaggaactgcaccagcatctggataaaaacccttcagtcttcactgtgaacacatctggttagttgatgaaactgttttcacagtacatctggctggatagatacaaccacacagccaccaccacaggctcgtattaactgagcagtttcttcccagcaaaactaactgcctggaaaaaaaacgcatgaacaaaacatatttgtaatttgtcaaatctaaataataccaatagctcagcgatttgctcttttgatcaagactgttttatgctaggaagtgtgctaagtgttttacatacagtgtctcgtctgctctttttttcttaacagctctgagagctagagattaaattattcctgtgatcaaactggagctcaggaaagctaagacattgtccaggttcccacagatggtgtgtgacagagctgggagctgaatgcagatcttgctgactccaaagctcagactccaaagctctgactccaaagcgcacgcaccacacacacacacacacacacacacacacatttaaagatgcagaatctcattatttagctaagctaccctccgtgcagcaaatatatcatcacagtgaaagtctagtgatagtactataaagacaaattatatgtaggcaggaaagagaaggctaatatccattattatcgttacagtggatttttggaggatttgacttttatcaaaaatattgttttaaatcaacaaataccaggaaattgaatccaacagcatattaaaaggatgatatgtcataaccaagtgggatttattctaggaatgcaagggtggttcaacataagaaaatcaatcaatctaatatgtcacattaataaaataaacaaaaaatatataatcatctcaattgatataaaaaagggcatttgaagaaatacaacaccctttcaggataaaaatactcagaaaagatagaatagaagggaacttcctcaacatgataaaggacatttattttaaaaaacccacagctgacattgcacctaaaggtgaaagactaaaagctttccccctaagatcaggaacaagacaagaatgcctcctttcaccaatggtattcaacactgcactggaaattctatccagcgtaattaaacaagaaaaagaaataaaaggcatctaaattggaaagtaagaagtagaactatctctgttcacagacggcatgatcctatatatagaaaatcccaaagaatctataaaaaagccattagagctaatgaacaattcagcaaagttgcaagttacaagataaacatacaaaacccagttatgtttctacacacctgtaatgaacaatccaaaaaggaaattaagggagcaatctcatttacaacagcatctaaaagaataaaatgcctggcaacaaatttatccaaggaagtaaaggacttgtacactgaaaactcaaaacattgcagaaataaattaaagaagacttaaataaatggaagaacatccagtgttcatggattggaagatgcaatattgttaaactgtcaatacactgaaagtaatctacagattgaatgcaatgcctattaaaattgcaatggcctctttttttctgtggaaatggaaaagctagtcctcaaatccacatgggattacaagagaccctgagtaactaaaacaatcttaaaaaaagacgaaaaaagttgaagaactcacactttcctgtttcaaaacttactacaaatctgtagtaatcaaaacagcatgatactgacataaggataaacatatagaaaagtggaataaaaatgagagtccagatatatacatatatttctattatttatatatatctcatatatatgtatctcctatatatatatctcctatatatatatctcctatatatatctcctatatatatatctcctatatatctctcctatatatatctcctatatatatatctctcctatatatatctcctatatatatatctcctatatatatatctcctatatatatctcctatatatatatctcctatatatatctcctatatatatatctcctatatatatatctcctatatgtatatctcctatatatatgtctcctatatatatatatatatatatctccaattgatttttggcaagtgtgctaagtttgttcagtcattcagtggaggaaaaaatagtctcagttggtgagggaacaactgaatttccacatgcacaaaaatgaatttggatccctacctcacaccatatgaagaatgaactcaaaatagatcagtgacctagattcaaaagctaaaatcataaaactcttggaagaaaacagaggtaaatctttatgattttggatttggcaatggattcttagacatgataccaaaagcactagcaaaaaaaaaggaaaaataaagataaatgtgtatatgtgtgcatgcatgtgtttgtgggtgtgtttgcttagtccagaattagggtagtagtaacaatgaggacaataacttcttagagcaccttcattcaggagttgaatcacagttcagttatcagacaatgccaggaagagctatacatttcttttggtatattgacatcttaatattattaagtcttccagcccatgaatacaggatgtttttccatttatttaggatactgaaacaggaaagaagaacagagctattcgtgatcatacagctaacaaatggaaaaatgacaattggaaatcaggtttttaaactcaaagttcatttctctctcccaaggagtgctaggacaattactcatttgtaatttgtgacaattcaggcaagggctgatctctagtttcccctgctcttgggaaaattttctcaaagatgctgtgaacacagtggggaaaaggttgcaaagagaatgcttaaactgcttataaccaaattgcttttaagcagcactttagtagaatccatttatataataagaatgaatatgctaactgtgagccatttttgtgtatccttgagggatctctacaggacaagcctcatttgaattattctcttcctttagtaaacatccagtacctgggatttactgatttttggcactgagtctgaattgctgagatttattttttttgtaaagatgaaattattaaagtagaatgaggatggaactatcatttactgaacacctagtaggtgttaggatgcatccttaccatccttgagtcctctaagctccaggaaaagaagcctttgtaccaggcaaagaagcctttgttctcagctcatacctaacataaaggaggattcacctcttcagaagattaccctccactgaagacacacaaattccccaatgtaataataagaaatggatattgtactgcaatcttatggtactgaagggaggttttacatcacacaccacgcaacataaacatctcctttaaaacttcttgtttttaatcctcaaatcttttctttttgccagtggcttcattattcactctcctcttacccaaaagagcatcacaaagaaatgtttcctattggcctgagcaattcaatggtggtgcccctagattgtaaacaaccctcaggagaggaaaaagtccggttgttaattaaacagatgatcaaaattgtttttgtagggtgtgtatgcatgtgcatgtgcctgtatgtgtgtgctgggtggttctcatttcatctgggttcacttttgttaccttctttgctctttaaaacaaccccaagagatcatttagtcccattttgtagaagaaaagattgctgcacagaatgatttggtaccacgtctaaggttgcacagtttgtcagtaggggaagccacagtgccatacagacctgattctagtattcatgatgccagaaactggtcccagaaatgaaaggctgtggctttctcgattttcatagcagtgggtaaattcttctttctaccacaatggaccttcttcaacgggccctgagtaagtggtggccaactatgtattagggtattcaagaaatgtatagtctaaagcaggacttagcaaactacaactagtgtgccagacccagcatgccacaggtaaataaagtttcactggctcacattaggcccataactttagatagtgtctctggctgctcttgcactataagggcagtgttgagtagctgcaacagtgatccaatggcctcaaagcctacagtgttttactatctagaccttagtgaaagaaggatgccaatccttggtctagagagtcaactgacagataagttggaaattgaaaatcagagcttaagtaggtggtaggggagcacaggaaccatgtaattgccaacaggtagactttgtttaaaaaccactcacagtaatcagcatccttccatctcccaattctccatattgttattaggaccttgaaaataaccaattaataaatcactatatattaattacttgctgtatgccatgctctgtcatatgtgctgtggatagagctatgagcaaaacaaaataaaaaatgagtgtggaatataggaggaacagaaagaaggctattaattgcttaattgatgttactgagagcctggagctcaataccagatgagactgcgagggagggaggcaggggccaggatgtggaagactgtgggattttattccaggtaaaacggtaagccactgagaaattctaggcaaagtggaggttgtcattatcatatttaatatgatcactctaactgctctatgaagattgaataattggaaggtgaggatgggagcatggagaataaggaggaggttactgcagttatttaggcaagacgtggaagtagcttgactagcctgataacagcagagacagagagaactgtttagatttagaatatgtttagggttagagctaagaggactcatggatcatgaggatgcatcttaaaaaagaagctcaaagcttgcttccaaaagaaccaaggagaacgtcgcaaattgtaagatttattatgattctcacctgcccacacaggcagggctgaggcagcttgcagtgcccacccaggtcctctggtgtagaggcagccatttttgctctggacagacttgtcctggggcctgtgcaccaccgctgcagaaacgggcagatgcagcctcaaaataaatgaatctccttgtgccaggtagctggcctcctcataaaaggatggattggactggttagagagatctcgacacttgtgttgcagatccattaacgtcagccacacgttaattctgagcaatttccaggtgatccaataattcattaaactgacaaaaacaaatctttggaaaaccaagctggtgacagatagaaagccaatgatttattgtctggagaggaataagtgtcttcctttccattcttcagtctgttgagtggatcgaagtgtgcagtaagaacaaggtaggtgtgagttctacttaatgggcattgttcaggcccaatgtggcattcatgtcacactgcttgcttcataaagtatttgggggaaggaagtataatgtagcaggaagacctggacactgaggttgggtaaaactgagtttgacttcctcctctgccagttattagcttctgtgaccttgggaaagtcactccacctttctgagcctccactggttcatctcttcaactggggtaataatatattttctcctgtactcatgtctgcatataataaatgaatatgatgaagtacagtgcctagaacattataggatactcaatgaatagctaacgttattgttatttgtgataacaaagaagatgggtgagctttttttcctttggtgtgtatattagttcattctcacagtgctataaagacatacctgagactgggtaatttacaaagaaaagatatttaattagctcatgattctgcaaggtgtacaggcttctggttctaaggaggcctcaggaaacttataatcatggcagacagtaaagggaagtaggcacatattcacatggccggcagaagagagagagagaaaggggaagtgctacacactttcaaacaacagatctcgtgagaactccgtcatgagacagcactagagggatgatgctaagccattagaaaccacccccatgatacaatcacctcccaccaggccccacctccaacactgtgaatcacaattcaacatgagatttgggtggggacacaaagccaaaccatatcaatgtacatacatcaatgtgagcctacaacaaggcattgtctgtattcatactgatgctgcaagaatgttatagaatacttgcctagacatgcaaagagaggagacatccaagacagcactttttttccaaggcagagtctgagaaaaaatgggaaatcagaagactaagaatatgagtgataggatttggggggtgctggtgaataggaataaaagggccctaggcttaaatagaagaattaaaggaggacagcttgggaacttacttccaagcagcagcggagaggatgagtcatgtgaagaacagaataatacttagaaaatgatgctgcaattggtttgaagtctggatggagaaggtgacttctgaacttagacctgcaatatgtcaggtgtggaggagacctcagacaccaaatggaagaactgattttctttaaactcttgtacttttggctgttcactatccttttcatcatctggtaatagcatttctgtattccctaagggcccacccctcaaaggtgcatacgtatctcattttctgtatcctttcagcttttatttatgggagctctatcacagctatagcaattctggacagaaattgtgattttctcagctgaaaatacctaaaagccacaaagatgcctgaaagggatgaattaccatggattactgttctcataaatagattcctggtctaactaaatgcatttaggggagtatctgttggaaatccattagacaaggcttagttggagcccatggaccctaagaacctccaagaggaactttgaactttggcacccccaaagtgtgtatgagaagcctttaacttggcctgtcttctaaagattgaaaatgagtttgaaatcataggaggcctgggaatgcttaaagtataacttgcccaccattggaggtatgctcccaagtattcaccagttctttctgtaagagaatcatacaactctccactattgtaatggggcttgggctgctttctgaggggggagtagactttttgacccactgatgtcaggtttgtccctgtgacttgttttagccaatggcatatgagtcaatgtactgcaaaccaagttcaagcagaagttttataattgtatgtttttatcagccctctttctctttccctctgacccatgaatgccatgtctttgatagaggaagttgcttcaatctggatcctggaatcagaagatgtatggagcagaactgcagctgagctgtgactaccagcataggataaagagagaaaaaaacctaagttgttgtaagctgctgaaattttggggatgcttgttacacagtgtcatctagcaaaaactaactgacataggaagtgagagcagccactaactcaaaagctggtcattaaacattataacagcagccagagatttttttgaatgctaactcttccaacttaatcccgtgatatattagccctgctctttccgctgattcaagagtttgacggctcaatggatctgatctttgcagtctaagtgcatgtgaagagtgtgtgtgtgtgtctgttgtgtgtgcatgtgtgaagcttctcacgttgtgcccaagtcagaaggacacatgttcctgcttaaagcttggatgactccatctttaagagttgtgcttcccaaagtaattatacgtagtcagatgttcatcattcaggggctgattattccacctctttctttctcagtatggatttgaatcatctcatgtacatcacagctgaagacaatagtgactgcaagaaactaaaggcaaagcccaaagtcactcacttgcctattgactagtcactgtcagaagggaacaacaattacatgccaagcactgtctaggtgctgaacatacatgattgaatgtaatttttatggcaattcataagtatcattgttcccattttacagatgatgaaactgaggctcagagatattaagcctcttgcccagaatcatataacttgcaggtagagttggaatagagcataaggtatttgtctatgtttttcctgactttagtcaatacaaaaaaacttaatttaaatggtagataatgtcaaataagatgaaaacaacatctatataccatttagaagtatttgggctgaggagttcctgtataataatgtgatagaaaaatggaagctaagaggcaaactcacagtcttgagatcacagagagaaagaacaagaaaaaccaacactgaggaccagcccttttgtccactgtgcctaaataggctccctggaagatcttgcagaatgtggtagcaatggagggtgagaagactctatttctattttaggagatttctcctttcgctcaaagtaaaaaagcaacagcttttgtttaaacccctaaacaaactgtttattctcttacctcatgcaaggagaaactgagaaatgcatgacggtgcactttgagtggtaatattgtcctcagcccatgttattagtgatgcaatggaggtacttaccactgacatacatttgtgataatttataagactggttagctcacacattgcatttgaactcttgcctgtctagagagtttcttgaatataaagcaatcacctaacttgaagccaaagtaagagtgaaagaaatcccagaatagtctaggtttggcaagtgctgatggattacttagttctgtggttctcaacaagggggaattttgcacccacaaggcaatgtctggagacatttatgtttattacaactgggtggagcggggaaagtcactactggcagctagtgggtagaggccagggatgccgctgaacaccctacaatggacaggacagccctcctcgacagaaaattgtctgctccaaaatgtcggtagtgctgaggttgagaaatccagactacctcaatgctcctgctttgaccaacatccagaggcaaaaagtggcttactcaatatcacacagcaagttagtgcaagatctgggcagcagaataatctgcaattgttagaagcacaggctctggaatctgaatgttcggctctggaatctgaatgtttggctttggaatatgaatgtttggctccaaatcttgggtttgattcttactaactgaggaaccttgagcaagtcacttaggctgtctgagcctcaggtagctcatccagaaaatagggagaataatggcacccatcacaaggtctttgaagaggatccaatgagataaagcacataaaggacttggcatagagtgtatgtacagtatgttttccatttatcattagaattctgtactttcttagcaggattcaggtaagaaattaattttaatttcactaatataggaaaagaaatttctaattaaacattgtcagctttttctatgtcctgttagaggagaaatctctgaatcactaaagaccaattcaatgatctctttagtctcatgaatgtaatccaaggaggcgccactaggtatgaagaaagggtgcatgcagcagaacacaaacatttttctcctttagtttgataagctcaacactgctatgcactattataaagtgatagagggtgtagtacgctgattaatgacccttctttgatctcatccccaaagatatccaagttctaatccgtagatccagtgactgttctcttatatggaaaaggggactttgaagctgtgattaagttaaggatccagagagagagagagagagagagagagagagagattatcttgaattatctgggttggctctaaacgttatcacaaggatccttgtaagaggaagccaagatggtcagaggaggaacaaggtgaagtgaccatggaagcaggggggggaatggtgatgtgatgtgtagccatgagccaaggattgaggatagcttctagcagctggagagggcagggaggcagatcttcccctagagcttccagaaggagccagacctaccaataccttgactttagattcatttgggacttctgaccttcagaacagtaagagaagaggtttgcttgaagccaccacatttgcagtaagtttttaatttgttaacagcagcaataggtaactattacagagggttattcattgcggggaatggagggcacatttacacagggggctgagtccctttctggggagaaaggaattgagatgctgaccccattcattgttgaggttcaaggttatccgatatctctgctgactcatgtggctgtgactgaggtcagccggcagcacaaaccatgagggacaaaagagggggactcaccgcagtggaagagacagctggacttgggacacaagaggagactaaggcttaggttgtcctgggagggaggctggtcctggagagtgtgaggccatggttgagacctttctagaaacatgactccagatgcaagttaggaaccatggcctgttatgatgaaaaatctggaacagacattgtcttaagatggggagagatgaccataagtgacagacctgagaaaccacagcatcagttttgggtcaatgcacagtggaagtacagggtgctgttgtgatggacagatttgaaccgcagcatcctgggggcagcgttatagtgagagggagagaaaacagaagcaccaaggattttagcaagttatcaggctaaactgaggaaaacagcaccccctcctgctacaaccatagatggacatgacattgtaaacccatcaaaatacccagcaagggctggatgtggtggctcacatctgtaatcccagcattttgggaggctgagatgggtggatcacctaaggtcaggagtttgagaccagcctgaccaacctggtgaaaccctgcctctactaaatataaaaaattagccaggggtggtggtacatgcctgtaatcccagctacttgggagactgaggcaggagaatggcttgaactcaggaagcagaggttgcagtgagccaaactcgtgccatggcactccagcctgggcaacaagagcaaaactctgtctcaaaaaacaaaacaaaaaaaaccagaaaagcctgaaagtcagtgaaggaactcctcaggggccagagatgacagccaggctgtagtggtggtatgtaagtttcagagatctgattatgggccaggagactgcagtatggggttcaaacacagaaatgggaagtgaattcaggctcgcaaaaggcagagaactggggcaactctccctaaaatctagagcagtggctctccttaggttagtactgtcagaggcatttgaaccagagtgaccccatcttgaataagggctgggtaaaataagactgagacttactgggttgcatgaccaggaagttaggcattcttagtcacagggtgagatggaagatctgcgcaagatacaggtcacaaaagccccgttgacaaaacaagatgcagtaaagaagccagcctaaagccaccaaaaccaaggtggtgatgaaagtgacatttgggcatcctccctgctcattatatgctaattcgaatgcattagcatgctaagagacactcccaccagtgccacgacagcttacagacgtcatggcaatgtccagaagttaccctatgtggtctaaaaaagggaggaaccctcagttctgggaactccgcacccctttcccagaagacacatgaataatctactccttgtttagcacataatcaagagagaactgtcagtatactcagtcacgcagcccataccactgctctgcctatgaagtagccattcttttgtttctttacttttctaataaacttgctttcactttactctgtggactcccactgaattctttcttgcgtgagatccaagaactctctcttggggtcttgactgggagccctttccattaacagtactgcctcctagggggacatttggggaggtgggggtgggcgtgttttttatgtttctgttatgatggcaggaggcaccagtagcatttagttggtaggagccaggataccagacatctggtaatgcccagggcagtctgactcaaacaaaaaactcctgccagcctgtgcagagttcaaatgcccgctgagaatttgcataggcaaaaaaatccattcattactctaagcctattgctatctaggtgaactcttctacacataaacgtaagactttttttttttcacttttaatacacactaaaattttcagaaatttcaatacgatgaaaatcaaggcaagctggtactttatatgtttgggaccacaggaagagtggttcactatcttggaaaatcacgttacccatggcaacaccggtcctggtgtttgcatcaccctatctgcccccatttccgcctgtgttcgtagttgtcacagctgtggtgattctacactcaggttcatgcattttattattccattaagtctcattgtgcctcagcagttactcgccctgatgccctgataccgcgtatgtgagttaggaaccatgggtctctggtggatgaaaaatacatatgataataaattagttttcaatttttaatataacatggcatttttaaatagttacgagtaggttctattagctgtgattttcatttcaaaacagtaaggaagatattacaaattgtttactagaaaaacagccattggatcaggtcagattgaaagtcattggcctggcatctccaagagctgtcccatccattgcagaggaaagggaaagattctgccagccagcctgggggaactgcaaggaggctgtctgtctattgtctgtctgagtcctctggatgcaagagaagaaaaatgtcacctgtgaataaatcaacccctgatcactggtggcctctgcagggtagaggttccacagtctgggaaatgaacacagccactgttgaatgaagtcaaaaagtcacggtcagcaagctgggaacagagagaggcaggtagacttggtaaccacagagcttagtgaccctccatggggctgtcagcgtgctggaagagttggagaggcagggagctctctcatagaaacttcttggcagccctgtagtcatccaacagagaatttcaaaagctcaggggaaaggcacagaaatcagtaattcatgataacccaaccctgggatgcaaaagaagttgtagttataaattcacttcctagtaagggggcaggttgcgaggttcactaatcctcatttgcttcatctgcagaagaggcaaaagaacatcaactttgtcaagaccggagactcttgactggaggagactttcccaaggacattctgtcatgtctggagatattgttgattactgcggagatgggggtggaggggttgctactgacatctggagaggagaggccagggatgtcgctgaacaccctacaatgcacaggacagacccacaataaagaattctttgtttcccaaatgtcaggagggctgacattgagaaagcctggaggaaagaacaaaggtcatgaaatgatgcttaaaaagagctggcatgactcctggctccttatgggggctcaggaaatatgactgccctgctggagtctaagcatccacgggtgttgctattttcagacctggaagtaagggaacaccgtcaccattgattgcattaattgctacagatatcatcaccattgtccttgttgtgattattactaatggctggtatttactgagaccttgcttagtgaggtcctgttctctgtgcttttcatgttgtgattcacaactctgtgaggtatatgaggtagttcttattattacctttattttgcatagaaggtagttgagtgcctatataagaggagctgaccacaggcagtacactcgtatgtcaaccattttcacagggtcttttatttgtaatcaatcaattaattaattttccattagtgagtatagttgacaaatacaattgtataagtttaggtgtttggtacaatgatttgatatacattgtgaaatgattatcacaattaagatagttaacacagctgtcacctcacttacatttttttctttggcaagaacatttaagatctaccccttaagcaaatttcaagcatacgatacggtgttgttaactatagtcaccatgctgtacatgaaatccccagaacttattcatctttccactaaaactttgtaccctttgaccaacatctccctgttttcttctcccccgattcctgccaaccactcttctactctcggtttctgagtttggctatttttgatcccacatgtaactgagatcatacagtatttatctttctctgacttatttcacttagcataatgccctcaagtttcatccatgttgttgcaaatggcagaatttccttcttttttttatggctgagtaacacccactgacgggcactgaggctgtttgtatgtcttgactattgtggataatgctgcagagaacatgggagtacagatagctccatcagcgatggattttgtttcctttgagtaaattcccagtagttggatttctggatcatatggttatttttaatttttgagaaacctccattttccataatgactctaccaatttacattcccaccaacagtacccaagggttcccttttctccacatcctcaccaactcttgctatttttttttttttttttttgataatagctattctaacaggtgtaagatgacatctcattgccgtattgatttgtagttccttggtgattagagatgttgggcaccttttccatgtatctgttgaccagttgtatgttttctttggaaaaagtctctaaaaacccttgactcattttttaattggatttgtgtttgtccggttttggttttcaccattcagttgtatgaattccttatatatttcagaaatttaccccttaccagatatatggtttgcaaatattttctcccattccataaattatcttttaattttattgattgtttcttccgctgtgcagaagatttttagtttgatgtagccctacttgtttttgtttttgttgcttgtgcttttagcgttacatccaaaacatcattgccaagatcagtgtcaagaaggctttcccctatgttttctttcagaagttttacagcttatggttttaagtatttaatccatttagagttaatttttgtgagtgatggaagatagggtacttagttttgttctttttttcatagggatcttctgtttttgcaacaccatttattgaagaaaactatctttcctagttgtgtatttttggcagattcgtccaatattaatcgactatttatgcataggtttattactggactcttgtttttcttttcttttgttttttttttgagacagagtcttgctctgtgaccaggctggagtgcagtggcatgatctcggcttactgcaaactctgcctcctgggttcaagcgattcttgtccctcagcctcctgagtagctgggattacaggcatgcgccaccatacccagctaatttttgtatttttagtagagacagcatttcaccatgttggccagggtggtctcaatctcccgatctcgtgatccgcccacctcagccttccaaagtgctgggattacaggagtgagccactgcgcccggtcctgggctcttgtttccattccattggtctctaggtctgtttttatgccagcaccatactgttttgcttactgtagttaggtaatatatgttgaaatcaggaagtggatgcttccaactttgttcttctttctcaagatttctttggctattcagagttgtctgtggctccaaacaaattttaagatttttttttaaaaattacatgaaaagatgctattggaatattgctaggatttcattgactctataaattactttgggtaatatgaacattttaataatattaattcttctgttccgtgaacacaagatatcattccatttatttgtgtcttcttcaatttctttcatctatgtcttatagttttcagcatacagatgttttaccttcttggttaaatttatccctaagtattgtattgtttttgatgctattgtaaataggattgttttatttctttttcagggagttcactgttagtctctagaaatgcaactgatttttgtatgttgatttcatatcttgcaacttgacagaatttcttgttgttgacaaactgagattctagattgcctgtcttaaacttctttagtttctctagaatgtctagcacataactggaaaatagaaaaggagagaaactaaacatttatttggttccaagcacatatttgtgtatatacatatatttgtttccagttgattctcattatttgcagatactgtattggtgattttgcctattcacaaaaatttattcataatcccaaaatcagtacctgctgtgcttttgcagtcattcccaggcatgtgcagagttgcaaaaaagttgagttacccattgtgtttatcccacctgagacccaacaaggccagaatctgctttctcggttctactctcatactataaatgagtatgcatcttgaagtttacttagcgctatgcttttcatacttttgtgccttttgctggtggtttttgctgtttaaaatggtccccaagcctagtgttaaagggctatctagagttcctaagctcaaaaattctgaatgaatgagagtttgcatagataacagtaatgttaactccttcaagaccaaggtttctcaaggtttctttgtttggtaccatgtcaaacaaagatgcaaagtgttgcactttgtgatgtggtttatggagaaaaatatatatttgttagataagcttcgttcaggcatgaggtatagtgctgttggttgtgcattcaatgttaatgaatcaatatatattaaataaggtgtctttacacagaaatatataaaacaaagttatgtattgatcagttgatggaaatgtcatgactggaggctcaaaagaaccaaacctatatttccccccaggagtaatggttcagtatttaataacttagtggttgtggagacattattgaacctaatcatagcaaataataagaatatacacacagaaacacacaccacacacacacacacacacacacacacacacacacacacacacttttttgatctcattttgtatttccagccacctgtaaggtaggtactattatggccacttgacagatgaggacactgagggtctgggaagccaggcagtttgccaatgatcacaaagacccagaaaccaaacccagtttagccagaattaatcttccatgctctttctagagaatgtcaactttttttcttttcttttcttttttttttttttttttttgagacagggtctcactctgtccccaaggctggaatgcagtggcaggatcatggctcactgcagcctcaacttcccaaggctcaggtgatcctcctgcctcagcctcccaagtagctgggaccacagccatgtgccacgatactaggctaattttttaattttttttttttttttttttttttttacagatgggttctcactatgttgcccaggttggtctcaacctcctgggttcaagcatttcacccacctcggcctcccaaagtgctggcattacaggtgtgagccaccatgcccagcccagaatttcaatatttgatgattgaatcaagtcatgttaaacatgcaaaagtacttgcatttttaattagttttttttttcttgtttccttctcttcccaactcaggaagaggtagagtccagggtggatcagcacaagcaaaagacacttccaaggactgtttctaaaacccactttactacatcccaaaacaggacaaatctcatgctagcgactttggggaagcaagtataagtttaaatacacctttctaacctaaaagacagtgaatcttaaatcactacaatatccacattttaacctttttattgatttctttgttttagtctgtaagacagtttttttcttattttttaggttagctagactcttttataatcttttagtttgtgattttaatgtttttgtttgctttgttttgagaactgaatgacttcttacactgtcttttttatcttcatctgttcggatcataaaaatggtctataagcctagatcctccagtgagaagaagctccatctaaagatgctggatctgtgcactgccacaggaaacattataaagatcaggtcatgtgatccacaagtcagctgtgaacactcttctgttctcttaaaatcgactcaagcccccagtttcatactcagctggaaaatttaatctctgctccaacatttctgctgatttcagcatcttatattcttacaattacctctaattctaatttattgttaatttcgccaaaacttcactctggggatgccaacagagatatggatgtcagaaactttttttcaattttctgagtccagaatttacaaaaggcatttacttaggtatgaaacagtcttaaaggaagatttgaggtgatgaacgacttctacccagcccacaacttgaaaattgatttttaggcacacgtgatcttaaaaatccttcagctatttctatttatgatttttttttaattgaccattcctgccccttttgcaggatgctttcctatgacttttccctattcctctccctatttctcccaagccaaattttctggggtacatccctggtcactaattctttgtattattttccttacattttggaagcttattattaaggtatttttcttaaaaaaagaaaaaccagaatcacctaagaagtatttttatcctagctataaaaataacattttcacctcttttctacggagtggaagctccttagaagagaggattcgaatgagtttaccagggatttaaagaatcaagactacggaggtgaggccaaaaataccagcatatgaatagcaattgtactttgcatctttgtctttatttgacaagatgccaaagaaaccttgagaaacctcagtctagaaagagttagcattactctgatctatgcacactctcattcattcatgcatgctttaagcaaatagttgttgaggtcaaactgttgtcaaacactcttttaggtgttggaaatagagtagcaaacaagagggacactttctcactggctgtttacttttgtaaggagaatgtaactcactcaatttctagtctcaaatgctgtcactttcaaacaaagatggccaaaatcaacagaaaatgtgatggtgtgcattaaccagcccatttttgctgtgtgagttctcaccatttcctgggcacatggaacagattctagttgagaaaacattccccttcattccgaatagaaatattaactctaataattactaatacttatgtagtgtttgctttatgagtgttttacattatttcactgcattatttaactcacttagtcttcaccacaagccaaagaggcaggcattatttttaccccattttatggatgagaaaactgaggcagagaagtcacccaagatagttacaaaccaagacaatttggctccagaatttatgtccttaactgccatgctattcagcctctctatgattttcacaaatagcaatgccaggtgactgctgcgttcagtgatccaacacagaattatcagagcaccaacgtcatgggttaaaatcttgcaaaatcctgttcacaaaagcaaagacttggaaccaacacaaatgcccatcaatgataggctggataaagaaaatgtggcacatatacaccttggaatactatgcagccataaaaaaggatgagttcatgtcctttgcaaggacatggatgagcctggaaaccatcattctcagcaaactaacataagaacagaaaaccaaacaccgcatgttctcactcataagtgggagttgaacaatgagaacacatggacacagcgaggggaacatcgcatacaggggcctgtcaaggggtggggggctaggggagggatagcattaggaaaaatacctaatgtaggtgacgggttgatgggtgcagcaaaccaccatggcatgtgtatacctacgtaacaaacctgcacgttctgcacatgtatcccagaacttaaagtataataaaaaaatttaaaaaaaatcttgcaaaatccttcaagtgtcagcctgaacaccactttcagagagcagtcttgtccagctctcatgcttggatcattcctgttatcacacattctcacttcatcacatgctccttggtgacctgtactgtaatcaataagtaattatttgtgtaattacttcatctctgtctcctcagctaaaatgcaatctccatgagaacagggatcatgtccctcttgttagccaccctatctccaatacctacaagagtgtttgacacatggtttggcctcaacaactatttgaatgaatgaatggatgcaaacatgaatgaatgagagtatgcatagatcagagtaatgctaactccttccagaccagggtttctcaacctggacgctattgacatttcaggccagagaattttttgttgtgagagctgttgtgtacactgtagaatgtttagcagtgtcccagcctctacccacaaccccagttgtcacaacccaaactgtccccaacatgcatgactttctgattgaatgagagggtgacagatgaacacaatgatatctcttattctagggaaacagagaatacagcatttttgaaggctgaattttactaataagaccagcttattataaaaatgtacttttgcaaatcacgttctttgggaacaaatataggaaggaaggttttatttaagaacgtagatgtcttatttaataatgacagctatcattgtgaagtacatattataagcctgtgttatgctaagtgttctatatcattatcatttagttcttataacaacttggtgggtcacagaggcccagagaacttagtaacttgaccagtattccatgaatggtaaataggagaactgagattggaacctaggtgggtctagcggatggcaaagcctttgctgtcagccaccacgctaagagtcccttagtgatcttaaagtcttgtttttgcaaacatttctgtatatgctctaaacccccatctatatttatgagaagccatctggaagacaaataggggtgcctccaggtgtcccaggacctgacacttgcagatatgtgctgaataactgaatgattagaaaggtctttcccactccaagtttattaaaattaagttcccattatttatgaaaggatatgtctatttcttatctaattcttgtccacatctaaacaaagaagtttcaccaagtcttcagtcactagagcttctgtagactcatgccttccacacttgccctttaacccaaaaccacttgttaaaatatttctcctaaaaaaaagatagtcccctccctacgaaggcaaattcatagtaaaattcccacctcatatatatacattctttaattaggtagggaatattttccctattttaccaatggggaaaaaatggagctgcacttattagtaaagggatggtccagaatgtttcctaaagcccattaatagatgcatattttttttcagtaaatccttttctgtatttctaatggagactatgaaaatgagatatgaagtctttccctagcaattcaggcaggatgatgccttccgactctttttgtttccttttgggtcatgtctgatgctctgaaattctctacctgcctgactgttgcttcaagacagtgggtgtgagccaaacaaatctatccaaccatttgttacatcccaaaatggtaccagtgagatagaaggccccaggtgatggggccccagatgcagatctgaatattctattctaagaagagcagtggaatagatggcccctatgaggtttttgatggaaaccctgaaaaaacaaatcaaaatataatagctcctgctgtcggtcccctccccctccccccaaaccctagcctggaactgggaggatttgagtgggccacaagaaaacagatggtgtcaccagaagaaaggaacttgttgtctgagagcggcctttcgaggcgtaatatgttctttgagggacgtgtttctcttgtgatggaatcaacgcaggcagaacatgctctctaaagagatcttctctctgagtccaatacttctcaaagaaagaaaaccgtaaaagaatacaaaggcagtgtcaattttctgctctccagctgcaaaaacttgcacttgaatgcgacccaaggatagttttcggaacttgtgcagtgtggctgagtactttttataggttgcaagaatctgtgatatgtttgatacctgtttggatactggcgccccttttggacaacagggtcattggagggagaggctctggcttgctcattttagaatccaagttacactgagcacaagatcgggcaaatacgacgtgcttaaaagggagaaagggtgaaggcagggagagacgccaggtttgtggaatcagtatagaagacagccgcatcaccacccgcttcattgctacttcaacctttaaactaggggtcctaaccttctgttgtggcttggacccctttggcagtcagatggagctcgtggataccttctcagaataacgtattttcaaaaatacatgaaatacgttgcatttcaaagaaactaattacattgaaaaatagttatcaaaatatttaataaaacaaacgtgtgaaatggtaatgaatgagcttttttattaacacattaaataaaaagatccaatggcatgtgtaaagacttcataattatgaaacagcaataagggtaaatgatattttgaaatacctgcagcacttgtaatgtgataattacttgtggtttctactggggacacagtaccagcgacatcaccactgctgtggtttattccgtcactcctaattgaggggcatgccaaatttcagttagatgttcgtgagaatgaagacacattttattttttctctctgagtttatgaccttcctgacttctattggcagatcagggtagaaacctctatggtcaatattggagtgacacaaggaccaattcctcaggccccttctcttcaatgtctgcattccttccttccactctagcttctagtctcctgggttcaaatgtatttgcttatatgctaatgagtcccaactttctggaactctctccagacattcccattgaagagcagctcagcatgaaagtcttttttttgtttgttttttttttttgttactttttttgagacatagttttgttcttgttgcccaggctggagtgcagtggtgcaatcttgactcactgaagcctctgcctcctgggttcaagagattctcctgcctcagcctcccaagtagctgggattacaggtgcccgccaccacacccggctaattttttttttttttttttttttttttttttgcatttttagtacagacgggggtttcgccatgttggccaggctggtcttgagctcctggcctcaggagatctgccctcctcagcctcccaaagtgctgagattacaggcatgagccaccgtgcctggcctgagagtcttgcaggcagctctcttaatccattagagctgctaccgcaaaatatcattaactgggttacttatgaacaacagaaatttattgctcacaattctggaggttgtgaggtccaagatccaggtgtctggtgtctggagagggttcacttcctggtttaccaatcgtggcttcttgctgtgccctcacatggtagaagggacaagagatctctctggggtctcttttataaagacagtcattctattcaccaaaagccactgttactaccacctccaaaggctccacctcctaaaaccatagagatgaagatttcaacatcttaattctggggaaacccaaacattcagatcaaagcagttatctcatcctaaatgtgtccaaatgggtctcagtccccccccctgcatcacacttgtccaactgcagtctcacccatttcagtaaatggggctccatcctcctgggggtgggcaggccaaagaacttggagtctgactctttcctttctctgtctcacctacatccaaactatcagcaagtcttgtcagctctgctttcaaaccgatccacgccccacctctgcttcttgccacctcagggctaccacctcgggggaggccccgctcacccctcacctaaatgattgcagtagcttcttaattatacccctcctcctcttacacctccctaaagtctactctcagcgtagcagccagagtaatctttcaaaaacaaaaggcaaggaatggtggctcacagtggttatctcagcgttttgggaggccaaggtaggatgatcacttgagcccagaagttcaagacctgccagggcaacatggcaagactccatctctatttttaaaaaatataaaaaataagccaggcatggtagcgcatgcctatagtcctggctaccagggaggctgaggcaggaggattgcttgagtctaggagttcaagaccaacacaggcaacatagtaagaccctatctctatttttaaaaaatacaaaaaattagccaggcatagtggcacaagtctgtagtcccagctaccagggagactgaggaaaaggatcacctgagcccaggaatccaaggctacagtgagctgtgattataccattgcactccagcctggacaacagagcaagaccccatctttaaataaataagtaaataaataaataaataaataagtgatacaatctgtgaggtcctctgttccaaactctccaaaaaccttttcttttcaccaagagtaaaattcagtcttctgaccacggactgtgagaatcatataaccctattacctctctgacgttactcaactagctccagctactttgcctccagtaattcttcaaattcaccaagccagttccgactccagggcctttgcccatgctgctcctctgtgggaacactcttcccgcatgcccttcatacccttccagtttttttttttttttttttttttttttttgagacagtgtccctctgtcgcccaggctggagtgcagtggcacaatcttggctcactgcaatctccgcctcccagctccaagcgattctcctgccttagcctcctgagtagctggaattataggcatgcaccatgcccagctaatttttgtattttttttagtagaggtgaggtttcaccatgttggccaggctggtctcgaactcctgacctcaagggatccacgtgcctcagcctcccaaagtgctgggattacaggcgtgagccactggccctggcctcttccagtttttggtcaaataaaatcctatgagtgaagcttcccttaaccaccctatgtaaaataattctactctccatcccggcactcatctttcccagttatcctgcttcatttttcttgaaagcactcatcaccattagatacaccaaacatgtacttgttttattcatttatggtccttccccttgtgttggaatataagtgttatgatggcacagactttgcctagattgtagactgatgtagcactaggacctagagctgggcactcagcaaatatctgttgaggggccgggtgcagtggctgacgcctgtaatcccaacactttgggaggctgaggcaggtggatcacttgaggtcaagagttcgagaccacggcaaaactccgtctctactaaaaattcaaaaattagccaggcgtggttgtggatgcctgtaatcccacctactcaggaggctgaggcaggagaatcacttgagcccgggaggctgaggttgcagtgagctgagatcgtgccactgcactccagtctgggcgacagagtgagactccacctcaaaaaaaaaaaaaaaaagaaaaaagaaaaaaaaaatttgttgagtgaatgaatgaatgaatgaatgaagtggttggcttctcataaaactgcttctttactttaaaaacaccacaggatccactgttagcacatgaagccgccacttcataatgagcacataattagttagatcatcccacattcatgcatgaactaatatgggccatctcatgcctttttactgaaccaaccaaggcagtgacaatggtaatagcatggacctaggctggccctcttcccctcacacctgaggcatgctgtttctcagctgggtagatagatgaggcactatgtttaattgctagtgaaaatattttccattttggtgtgctttcaagtttgcaggtttttttctatacattagatttaatcctctctagtgcctcagaaaaagttgcttattcactcaatatttgcgtaagattttattcatactgtgagcatagcatgttaagttagttacatgtttatctacctcttctgttggtctatgaatttctagaaggaaagaatgtttgtattctcaaggctgagcatagtatctggcagatagcaaatgctgatccaatatttgttgatagtattattatctaatatttactgagttatttcagtgtccttatattaaaatggggatactattaacagcccctttcaagactgctgtgagagtggaaagagttaacctaagtaaaccactgggaacgtgtctggcacagagtaagcattcagtattagtcactgtccctcctgttgatgatgttgtcatttgaacatctatttaatgtactcaagtgctttccttaaaacaattatgtgtgatgataaaccagccataatcatgataacactgaacagttattgagcagctaataaatgccaagtttgaggctactttaaaaatgcatcatccaattttcacagcagccatataagatacatacaattctcaatttagagaaggaggcacagattcagaaaggttaagtcgccttctcgaagtcacatagcaaagaagtggcagaggtgggatttgaacctgagccgctctgactccagggtcctaactactatcttatggtgggtggcattgccttaattctaaaaaagaagaaacagagacatgaagagggcagttaactggatcaaagtcacagagcttacaagcattagagctgagatttgtgatagaagaatttcctctgagccagtgggccagaggtactgtctggggtctggaatgcacttcataagcacaaacagagatggaggagatggtcagatgtctggatcatcccctgagggtgagttaatttcgtgctgttaaatgaatctgaaatttgaaagcatactgaataaaaccacgcattttccctcatcctaatgggacattaaacagctacttacataatgaattatttaactgctgactgataagtgctgtaaggtgcaggggctctgagagttcatggcaggaagtcctgcctgagcctgggtcagaggaaagaaaccacaaaaacaaagatgcacgccttccagcaggaggttatggtaatttgcacaaacctcactccggtggggggcctgagaagaagctgaggcgcaccttccaggggaaacaggcttcggagaattaaatgatctcttgcatctcctctcaatcatatgatgtaattattgggaaatgtcacatgcagctttttttgcagggacaggtgtgtgcgaagaaaggtaggcagggttaatattttttcttctggtttatgagtttcattgattttcctagaaggaaaacccttatttgaccttgttcccacaagcaggtttggcttgggatgagaagtctggcagctgttcaaaggcagatgctcctggcctgaagccccaagggacgtcaagaggcagcgagacaggagcaggaaggtggagacagctctgtgcgcctgcaactctgacttgtctgctccgccacatccagctcatcacccaattgtgcaaatttaactcctaaaactccccccaatcttcccattcctctcagccccattgacagcaccccaacgcaagatgccatcatttcttgaaacagacacttaactcatccctcacactccattcttgtttccttataatatcttctcatctgagccaaaagtgaccttcttaatacataaagacatacatcactgtcacctccatcttctcaaaacccttcagctgcttctcattgcacttgggataaacataaaaaatctttttccaaagttgggcacagcagtatgtgcccgttgtcccagcgaaagtgggaggattgcttgagcttaagagttgaagtccagtctgggcaatacagcaagactatgcttgaggggggatggcggccagagatactgtagacacactgaatttggggatgctatttagttaggattatgcgtggctgtaagttatagaattgcgatcaatggtagtctaaacaatctcttatcttactaacaagaagactggaggcagacaccccaaggttcgttcagcaacttgatcttgtccctaaagaccaagttccattccaatatggacttccatttttagcatatgggctttttatactcatgcttcttgtcccatagttacacggtggctgctgttgctccaggcatcatgactatattcaaagacaagaaggagaaggtaaggagggaaattcaggacattaagaaaggattatatcatttctttctccttatatcaggaaggaaatatttcccaaagttctccagcagatagctgctgctgtttcactggttaaatagtcctatgtggccatccctaaccacagggggagttggaaaattagggatcaagcaaggggaaacaggagtgctatgaatggctcagatcgatcatgattctcattctagggcttgcgtattgtaccctttccccgccctgccccaaatgagattgagattctgtcaggcaggagggctgactatttagtagacaaccaacagtgtctgacagagggtggaaggtgggattgggttttattcaaacaaccaccttctgagtgtgaaaaatggcagctacctcttgacttcagtactgtgaaaactgccacttgttccagctgagcctgcttctcttggctcatacattcccaagaagatgactgtgcagagcggcaagagcttccctgtttctcagaatattctcaagaaataaggctacattaataatttgttttcttggtatgggccattcggttgcaaaacaatattgcagtcatagcacgatacttcccttcctcatttacattcactgttggtttaattatgcttttcagtcagaatacttattaattttatagacctacctgaaaattaaattggataaattccttttgcctgataccttgaagaatgtgtttttccaagctgttgatggggcccgcttcggccccgtgcaattttgttcccctttaagttcatttgcaaataacactgtgttggtttaaagggcattcatcatttctgagcaggagaaacactgcaaactgcagcccaattcggaggaaagtaggaggacaatggagaaaattgccaaatattttattttctcattggagaggggagtcattgagtgaggcataaaatttcccttaggattccatgaatccatcttgctggtgaagagaacactacgtgttactggaaggcatcagcaaagccacagggtaccaaaaggacacagagcagggaccttcccaactgaccagggctaaagcggctcaacgtgagaacagcaggcagtgtatttattcattagacattcactgtgtctcaggcacgatggagctaaaaacgcaattaagacatattacctactctcaagcagcttgaattttcatagcagtagacaggcaaataaaggcacagtgatgataaagtgtgtctatcataaggtagaaaaagcacagaatgctgtgagattccagaagcagtacaacacgcccctagcctgaaagctctatgaggatgggaagtgtatttatgctatgctgtgctgtaactttgctgcctagccccatgcctggcattcagatatttaataattagttgctgaattgaattgaattaaaatcaatccagcctggtggcatgtattatttaggtgtggttagctgctataacaaataaatctccaaatctcaatggctgtaacacagtagaaaaatgcatatgtgtgtgtgtggggtgtgtgtgtgtgtgtgtatttgctttttcttcacaaagatcacatcagatctgagatgatagagggtgtctgtcccaagctgctatttgagaactgaagcttctcccatcctgggtctcttatcatcttctgagtcctcacccccacttaatgaatagagtacaaaacaaaattaaaattctaaggccccccaaccacctgaagagacccctcctttaggccaagggtcaagttaacctgaaaatcaagttcaggccacaatgagaagtgggattgggacatgcctcattacagcttcctcccttttgcaattactgatggaacagactctttaagtctggtaagaaacatttacaatctattctttctgaagccttatacccagtggcttcatctgtctgatataatgttggtctccacaatcccttatgataatccacagccagctagctacctagctagcttgcttgcttgcttgcttgcttccttccttccttccttcctttccttcttcctccctccctccctccttccctttcttctttccttcttactttgagacagagtctcactctgtcatcggggctggacagcactggcgcaatctcagctcactgcaacctctgcctcctgggttcaagggattctcccacctcaggctcctgagtagctgggactgcaggcatgtgccaccacaccaagctaagttttgtatttgtagtagagacagggtttcaccatgttggccaggctgctttcagactcctgacctcaagtgacctgcccaccttggtgtcccaaagcgctgggattacaggcttgagtcacggtgcccagctcacacattcctgtctattgataataacattttcaacgaattgccaatcagcaaatcttttaatctacctatcacttgggagcaccaattcctaccttattacccccagcatttccagttgtcccccctttctggactgtaccaatgtatatctcacatgtattgattaactccttatgtatccctaaaaggtacaaaaccaagatgtggcctgaccaccttgggcagatgttcttgggatcacctgagggctgtgcctgggccattggtctctcatatgtgactcagaataaatcctttcaaatattttacagtttgactcttcgtcaacaaaaggaaaagagaaaagagagccactgggaagtttaaagggctaggattagaagtggcactcaatgcttcctcttgcattccactgaccggaagtcttacatggccatatctaagtataaggccggaaaatacagtcagattaagtgctcaggaggaaaggatatagatttggtaaaaacgttactggaaagcggtcctaatccagaccccaagagagggttcttgaatctcgggcaagaaagaatttggggcaagtccacagtacaaagtgaaagtaagtttattaagaaagtaaaagagtgaaagaatagctactccatcaacacaggagggcgttcctgaaagtaaaaggagagacgtggccaccctgggtacaacgcttgcttatatataggataacaacaacaaaaccacagggagatgtgctctattacaagggtttgtgataaagggttaattttcctaattactatatattgcaagaatcaatattattatctctaaagcaaaattaggaaggcttctgtcagaggcgtttgaaccggagcaactctatcttgaatagaggctgcataaaataaggcggagacctattgggctgcattcccagatggttaaggcattctaagtcacagaatgagataggaggttggcacaagatacaggtcataaacaccttgctgacaaaacagattgcagtaaagaagccagccaaaacccaccaaaactaagatagcaacgagagtgacctctgcgcatcctcactgctgcactccaccagcgccatgacagtttacaaatgccatggcaacatcaggaagttatcccatatggtctagaaaggggaggcatgaataatccaccccttgtttagcatatcattaagaaataaccataaaaatgggcaaccagcagccttcggggggctgctctatggagtagccattctcttattcctttactttcttaataaacttgctttcaaatttgctctagggacttgccctgaattccctcttgggccagatccaaaaaccctctcttggggtctgaattggggacccctttctggtaacacttctgttttcaagatatcaggatatcacggcattcctgactctgggtctgtttagtaaaggttctcaatctgctcccttaactgtaaacatccagagactaggaattcctaacttcctgggaatgcagcctggcaattcccagccttattttcctagccctcactcaagatggagtcgttctggttcgaatgcctctgacaaaaacttcactgttttttatatgtagctggaaaagtggtcccaaacaatctttaagatgaataggagatatccccaatgataaggagtaaagaacattgcaatcagaagggttagtgtgaataaagatagcctggggttcataaatggtgaaaaatcacatgcacagtaagataaggctgtaaagtgaggcagaagttaagtcacagaagggattttacactatgccaaggagtttataccttgtcctaagggcaactggaagccactgaagctttttgattaaaagggtagggtggtcagctttgcattttagaacaatgcctttgggctaggtgtggaaattgtggggggctatcatacacagagatggagaggatagatttgagaaatattagaaggtaaaaatggaggggctaggtggctgagtgtgttagaggtttttgaaccagagcaactctatcttgaataggggctaggtaaaatgaggctgagacctactgggctgctttcccagatggttaggcattctaagtcacagaatgagggaggaggtcagcacaagatacaggtcatggccgggcgtggtggctcacgcctgtaatcccagctctctgggaggccaaggtgggtagatcacctgaggtcagaagtttgagaccagtctggtcaacatggcaaaaccctaattctactaaaaatacaaaaattagctgggcctcgtggctcatgcctgtaatcccagctactctgggagactgagacatgagaattgcttgaacctgggaggcggaggttgcagtgagccaagatcgtgccactgcactccagcctgggtgacagagtgagactccatctcaaaaaaaaaaaaaaaaaaaaaaaaaaaaaaaaacaggtcataaagaccttgttgataaaacaggtctcagtaaagcagccagccaaaacctaccaaaaccaagatggtgatgagaccatcaaccaagatggtgatgagacctctggtcatcctcactgctacactcccaccagctccatgacagtttacaaatgccatctcaaggtcaggaagtcaccctattggtctaaaaggggagacatggataattcaccccttggttagcatatcatcaagaaataaccataaaaatgggcaaccagcagccctcgagggctgctctatggagtagccattctcttattcctttattttcctaataaacttgcttttgctttgctctatggactctccctgaattatttcttttacaagatctaagaaccttctcttggggtctggatcagcgcccctttcctgtaacaatgccaaggagtttgcaacccgtcctaagggcagttggaagccactgaagctttctgatcaaaacggtagtgtggtcagcttcgcattttagaaggatgacattgggcttggtgtagaaattgtaaggggctatcattacacacagagatgaagaggagataatagacttgagaaatacttagaaggtaaaaatggcagggctaggtggcttattggatgtcaatcagcctctttgtcctttctgtgaactcccttcccttgtcttctcattctgagtaccctagctaaccttctccacctgaatgcttagtccaagttgtgaccagatccatttggctctgggggattagacttggtgccatttattagggatattggatatattccaatctcgacccaaggatctggcagggcaaaaattattactgaaattctaaaatgtagataaatttatctagaatttatctgggaattcaaatttatctgcctaatcattgttcattttatggccagaaatttatagacagccccattttctgaacagaaattcagagatacataaaattttctggaggtgtgctttacattgataaagttggggagggggtgctagatgggaaggaagtgctgtggctggggcaatactttccctccctatagcgacaagtgtcactggtcttccaaagcagtactgtgtaaaatatcccataaaatggggaaaatggtaacataaactagtattggtgctaaactagtggtttagcactcacgctatggcattagaggttagatcctgctttcctaacttactggttgtgtgacctctgataatcatttgactccacgggagttcagttttctcagctacaaatgaaggtagcaatagctctagtcctgcaaagttgttatgagatgtaatgagataatatgcattcagttcttggaagactgtaggaacaaattaagtgtaatctttatggtgagagaatggctactttcccacagacaagacatttgattcagctgcgtatgttctttagccatatcaatggtaataaatatgggttgaaaggattgatttaatgatttgacaaatattttcaaatatattcaacatatattgtgtatataatatgtgcctaattttggagacacagtgttgaaaaagagcaagcttcctactcaaattgaaatttaattgtagtgtcaaagaaaaacaatgaataacaaacaaacatgcaatatgatgctaagtagtaatactgttatgaagaacaaataaaggagggtagaaggtatagaaagtgacaggagatgcttttaggtagaacagaggtctgaataatgcaatgaattaaagggtgaatgaggaaatgaatgaggagcagaaggaagataaagcagacagtgtgatggtagcttccaagaacacttcagtccagataaaaatgtgtaggatggatttagactttccaaacataaggttaactttaagagtctagaaagtgataagtaaattaaagcaaaaataaatagaagaaattgatacaaaaaataagagctgatataaagaaataaaaaagcaaacagataaaagcaaaagttggttctttgaaatgacccacaaaattgattaactgtcagattgctgaaacaaaaaagagaaaacacaaaataccaatatcaggagtgaaggagacattgtaactacagatcctacagacattaaaagtttaagaagaaaacattaggaataattgacaacatattcaataatctatatgaaatggtgacattctttgaaaaataaaactcaccaaaattgacacaagatgaaacagaagatctgaatgatcctaaatctaataaagagattgagttggttttcaaaaacatcctcacaaagaaaactcgaggcccagatatttcactagtgacttctattacgcatttaaggaaagaataataacaatcttatatgaactttatatgaaaattaaggatagaacactttctaactagttttatgaagacagcaaaacccttataccaacacttgccaaaggtatcacaaaaaaatcataattacagatcaatataatttatgaatacttctcaaaataaaaaaatgcttaacaaattgttcacaaactaaatccaataatatataaaaaataataatatgtcatgaacaagtagagcttatcccaggaatgtaaggttggtaattcaccatattaacagaaggaggataaaaatcatataatcattttaatagattcagaaagcatttatcaaaattcaacacacattcatgaataaaaactctccacaaattaggaatataacagaacttaatcaagttggtaaaagatatctgtgggaaacctatggctaaacatcacacttaatgctgaaagactgaacacttttccaataaagatcaggaaaaaggcaaggccattttaccacttttatgtgacattgtactagaggttatagtcatttcaataagtcaaggaagggacataaaagacataaagttgaatgctagacataaaactgcttctatttgcagatgtcatgagtgtttatgtagaaaatattaaggattctagaaagcaactactgcaaataataaagcattttagcaaggtcccaagatacacaattaatatcacaaaaatcagttatgattttatatactagcagtaaacaactggaaaatgaagttaaaattttcacttagcctcaaaaaacatataatacttagaaataaatttaacaaaacatacatgaaagttttaaattgacctattaatataaaacattcctgaaattaaaggacattaaataaatggagagctatataccatgatcatagattgagtgactcaaaacacgtggtaggatgtttcatttttcattcattcttcacccaactccaacacacacacacacacacacacacacacatacacacacgtgcacacacacattgcttcttctccagctttaaagttatccaactgaaaatttaatattattttattgtggtaatgtgagatgaattaaatgtcattttactaaagatgtctccccacctatggcctattaaagcacctgtaaccactgtatgaatcactccaaaaagtcactttcttagtggtagaacaagactctgcacgatgtagactctgcataccttcccatccacatttttcagatttactgaatgttttgctcattccatctctagtccattggcctttgcatttgccattcattccggaaaatttccttccctcctgttgcaaaaccattagatctcagcttagacaaatactctaggaataatgaaatgtctgccgttcctccaggaagggtcccaccccaatcacagactgaacaatgtttacacataaacacattcccatctcattcatgtaagtacagtttgcaagaaatctgcgatgcaaatgtgtacatattttcaaccaatgcttgtggggaaacattgtgctttgggccatttcaacttcaaaatctaatgaatctaatcattccaaatattctcatgggattaataacatatcttatatgtataaagcatggcctcttcccatgagtcccgactacaaccagtgttttggagaatgtgtttcactccaacattcagactcctgagatcttgataggtatgtaaattgcctgtccaatctccattctccccttttttcttggtaacagagccctgattttattcagagaagcaatacatctaactaaaggtctatatccccagccttcactgtagtaaggtaggacagtgttgactaaattctgacctttatagaagtgttgtgtggcttttcaaggaatattcttaaaggaagctgattggggtgagaactatgttttcggggattttccctctttttccttccttcctgctgtcaataaagtaaccgtgatgaccagaactttaacaactgtgtttgaccatgaagctatcttgaagatggagttgctgtgggctcagttatgccagaggagacaacaagaggggtagaaactacaatatctgctttgggcaacgtacctctgcactgcttttcatgggacagtaagcctttgagagtccgagccacggccattgagcgttttcggttatttgcagctgaaccttatcaaactaatattgacaacttgggaatttaaccaacaggaagtgaaaaacatagctgccccagcctccaatcatacaggaaaggaggagaaaaggggggagaagagagaggaagaaaaggagttgaggaagaggatgaagatgatgaggaggaagggaaggaggaagagcagaagaacgatgagaatgagaaagatggggaggaggacagtgaggatggggaggaggacagtgaggatgaggaggaggattatgaggaggaggactgtaacagcagcaaatacatagatggtgcatgtgtgccaggccctgttacctattcttactgacttaatcctcttaatcaaccctatgaagtcactattatcatccccattttataaataaggcgaggctaagagaggtgaaataaatcacctgtggccacacagtttatggttgaaactgctgagtttactcctgctatgatcaaacctctttcctgtgtctttgaaatactgaacagcaaaggctgcaaggattggaaaccctttttagagatttcaaggattgccttcttgctttttagtttttcttggtctcgcttcccccaactattttgtagattcctttaaaggaaggagagtaacatggtttgtgaaaaaagtgaaatataatgatatgatatataatgtaaaagtaggcttaaagatacttgaaaataagtagtcataacagggaaaacgggcacatccaaaaactacaatcaaaagtacaagggcactctttatataacattctcaaaacgtcaaagttacagcgacatgccaaaaattatacaaatcaatggtttccagggttagggttcggggaaggctgtgctcgtcaatagcattgcaccagtgttagtttcttgggtaaagaagggagcttcaccattacctctgggtcatcctgggcacctctgtgttgactgcccaggtcatattctgttaacacggcttaaaaaaatttttttaaaggaaaacaaaagtgactttaaactcacccctgaaaaaggttattaaaagacagtatttactttacaaaaaaaaaaaaaaaagcaacccaacctctttgcagaagttcataaaaatccctgtacgcatcaagactgagaggcttttcaattataaatgagactttaaaaggtagacagaacccctgaagcttccacataccacgcaccattgtggcggatggaaggaaaaccgtcgccctgtgttgacggcgtatttataattgaagagtttgagaacgcaaatgcaaatgaatcaacaccaacagggatgtctaaaagacataagtgagaattacggcaattaagaatgttgtctcagaggaaattagactgggccattaattacaatgccttaaagggaaagaggtcccagtgaaaatgcaataaattaaaatatcaaaaagaaaattagtgggaaggaaacatggaagtgccaatgagaagctaatctcagaggtggtgatggggaagagaagggagaaggcatattgaaagcgaatattgaagaggtgaggcagacctgcccaggctaaatcctcctgccctcccttcttttctcctcctctgtctccttccttccctccttcctttttctctccttttcttctttcctctctcctttctcacctcccatctctattctttccttacttttcttcctttctccttccttctcttacccctccatacttccccctttccttccttctctactccccctttttccttccttcccaccattcttttcttcttctgaccttccctgctctctcctttcacttttcctgtcccctcctttccctgtgacttcaaagtaccaaatcctaagaggcagagacacaccaggagccatcgctctgcccagggagaaattagaatctgccttgggaagcccacacgcatctgctgctgcctggctgcatctcccctgcccttgccctttaaatcagctgccaggctcctcaaggggagcagccactagactgtccccagtgaatggcccaggtgtccctgctcactcctggtccagtgacactctaatgttccttggctttaagttctcaaaaatcatgtgtatttatttgtctcctcaacttggcagggaaaatcttgagcgtgtgtgtgtgtgtgtgtgtgtggtgtgtatgtgtgtgtgtgttttgttttgacatggagtctttgttacccaggctggagtgcggtggcacatcttggtctcaaagcaacctctgctcccaggttccagtgattcttatgcctcaggctcccgagtagctgggactacagtcatgtgccaccaggcccggctaattttgtatttttagtagacacagggtttcaccatgttggtcaggctggtctcaaactcctgacctcaggtgatccacctgcctcagcctcccaaattgctgggattacaggcatgatcaaccacgcctggccagcttttgttttttgatataggtactaaccagaccctctggatgtggcacctcctctcttctggtgttcttccaactctacaccatggacatcctctaaccctaccttgccgcaatccagcatccctctctgccacaggcaggaatgaccaatcctccaatttcctcacctgtctaggcttccacatgacattctcaagtatctctatgataggaagagttgctttctatggtgcaaaactgtcccaacttcagtggtttttttttttttttcctgtaaacactttttacctgcataatgattcacttaatagtactctttaaaaaaccgcattaaaaattattttaaatttcaatagttttggggggacagatggtttttggttccattgataagttctttagtggtgatttctgagattttagtgcacctgtcaccagagcagggtaccctgtacccaatatgtggtcttttatccctcactcccccaacttaccttccccccttgagtccccaaagtccactatattattcttgtgcctttgagtccacacagcttagttcccacttataagtgagaacgtactatatttagttttccattcctgagttacttcacttagaataatgtcctccagctccatcctagttgctgcaaatgatattatttcattcttttttatggctcagtagtattctctgctgtgtatataccatattttctttatccacttgttggctgatgggcacttaggttggttccatatctttgcaattaaaaattccattttatttatttatcgagatggagtttcactcttgtcacccaggctggagagcaatggtgcgatctcagctcactgcaacctccgcctcccgggttcaagcgattctcctgcctcagcctcccaagtagctaggattacaggtgcccaccaccacacccagctgatttttatatttttagtagagatgaagcttcgccatgttggccaggctggtctcgaactcccgacctcaggtgatccacccgccttggcctcccaaagtgctgggattacaggtgtgagccactgcgcccagccaaaaagtccattattttaaattcaaatactttagcctcacctgaaagcaataacatctgtgaaaccaaggcttttctacacaagttatggatctttttcttgtgaatattaacataaacacatgtctacacaacgtaaaatgtccaatcagtttccttcatgggtttgcctcttgtgagcggcaacacttcttgtacaagaaacactgctggggtgagaaagtacaggatacgaattaagtacaatccaatttggtttcaccacctgctgtaggatgttgggaaaactgggtattacccttggatcctcagtgtttccatctgaacactgggtataattatgtttgtctttctaacggttgtttagggacttaatgcatgtagtaggatacatgtatttcctttctccatgactataactcctatctccctatcctgtgtgttcaattcactaggaggctgggacaactttaataccacttttaagtactggtcagatgtctagccccatacctcatgtttgcttaagtggtggtatgagaacggcgagggcgtctgaacttctttcaaagtagaccataagctctttgataaataggcaatatttcacaattctttgcatcaccttgatgctcacctggtgccaagcatatggaggtgctccatcaatacctgctgacccactgattgatttcccattctggccagaactctgagcacagtcaatgtggggctctgctggaggtgtggaggtgaggtcggctaacagcttccatggagcagacctggctttaagacatggctgcaaatagttccccaagctcgaaggcttgccaactcagctaccatttcccatctgtgtttctatttttcctgtgagagtagctttattgatctcattaattctcttttccatttttggcatgggaaggtgatattatccacgctttaatgccttctgtgttttgcaaattacaggattactatagatggaatgaccaaaaaaataaaaataaaaaaacactgttttcacagaattgtggcaaaagccatgaactgtccttcatttaaatagatgggggtaatctgtcctggggggtccattcactcaggtccaaggtccgcaaacacagagggagaattttctctcagctatttctgtgtgaagcaatgcaaatatttttctcacttgaacattttcgtttttgaattactgatggcagtgataggtttcctaataaggtttcttttcttcttttacagcaattacatttgactattttttcttctcttcattgaacattagtttgaggaggtcttaaaaggattcatctgaggaatgctgtggctcaaggtttggagttcaataagtattttatgaaaaagaaatctctgctgctctgctgtaaagacaaggaaaagtacctcttatgcaagttcttttagttcgataactaattaaaatcacaaccaccactaagagaaaagtttctcctgatcttatctactgctacttagaactctttacaagagaaggagaaagaaaaataaaataagtgatttccccatagactgtgggtctcccaggacaggtctgctttatctttatgggtctccccagagcctaggttagtgtctagaactgcgaaggcacctaataaatgctgactaaagagcaaaatgaatggacttgttttccttttaattttttaattgaaatataataatctatatgctcaaaagtgcagaaatcctaattaaacagttagatacatttttacaaatttgcaatcacctgcaaaaccaaaacctcaatcaagaaacacaataacataaccccagaaatcctgtacccgccactttccaatcattatcctccaaatataaccactgtcctgacttctaacagcacattctagttttgcttttgggattatacagggtgtcttcttttgtgaccatattcttccattcaacattagaattctgaactccatctgtactgatgcatatactttcagcttgttcattctcattgctatagggtgttccatcatgggtgccatggactgaatgtttgttttcccccaaaactcattgattgaatccctaattagcaatgtgatggtatttggaaatggtgcctttgagaggcaatttggatttgaagaagccataagagtgaggctcttatgatgggactaatgcccttatgaaatgaggaaatgacatgagatcaatctctttttctctctctccgcttgtatatgcaccaaataaaggccatgtggacatatgagaagacagctgtctgcaaaccaggaagagggccctcaccaggcaacaaattagctggcaccttgatcttggactttccagccttcagaactgtgagaaataaatatttgttattgaaaccacccagactgggtgcagaggttcacgcctgtaatcccaccactttgggaggctgaggcaggagtatagcttgaggtcaggagatcaagaccagcctggcaaacatggtgaaaacctgtctttgctaaagatacaaaaattagccaggcatggtggcatgtgcctgtaatcccagctattccgggggctgaggcaagagaatctcttgcacctgggaggttgaagctgcagtgagctgagactgcaccactgcattctagcccaggcaacagagagagaccttgaaacgaaaaaaaaaaaaaagagaaagaaaagaaaagatagatcatccagcctatgatattttggtatggcatgcaaaactgaccaagacaatggaaatatgccacaactaatttatccattccacagctgatgggcatttggcacctttaagtttggagctatcatgaaatgcattgccatagaaaatctaatacgtgtcttttggtaatcacatgtttttctgttgggttgtgtccctgggaatggaaatggatcataagatgtgtacagttttagccttggtggaagctgcccaacattttcccaaagggtttataccaatgtatattcccagtaacagtacataaacatcctacttgctccatatccttgccagcacttgatgttgtcagtctttttaattttagcattcgggtgggtgtgtagtaggatctcattgtgtatgtgtgtgtgtgtgtgtgtgtatgtgtgcaatttctctttattttgagataattgtagattcacatgcagttgtaaaaaataatacagagatatgtcatatgcccttcactcactttctcacaatggtaacatcttgcatacctacggtacaatatcgcaatgtggaaattgatgttgatagaatctaacctcagtcagatctcaccagttttgccatgtatagagtcactgatcatcacagtcaaggtatggaacagtgtcactgcaaggatctttcctgctacttttatatccactgctatctccatgctgctccctaacccctggtaaccactaaactattccccatatccataatgttgccatttcagtaatgttctatgaatggaattgcatagtatgtgaccttttgagattggctttttccactcagcgtaattctgtcaagatccatccaataggttggttgcctgtatcagaattgcattccatgaacaaacttttgaagaaactacgcatctcatttccaaacagttatttttagtagtttatttgttttctattcaagggatggcaaaacagacttgcacatttttttcatttgttcattagtttaatgaacatttataaagtaccaactgcatgttgagcactgtgctagatggtgagcacccaagagacacacagggctctgctacgtagggttttccgaaaaattagctgggcctggtgatgggcacctgtaatcccagctatttgggaggctgaggcagaagaatcacttgaacctggggggcagaggttgcagtgagccgagatcacaccactgcactccagcctgggtgacgagagcaaaactccgtctcaaaagacaaaataaataaataaattggggagacagacttatacatttaataagacaatacagcattacaggtggcaacacagagctgtgcatacatttcagtcaggaataaagaaggaaatggctgactttatgaggatagggtggaagacgagtccaggagatactttttaagggcatgatgcataaaccaagtcttggaagttgaataggttgcctgatgtctgtggatgagagaggaggcaagagaaaaaggggcgtttctgagcataaagaacagcttaggcataagcatggaggcgggaagaagtcgatactcaatttggaactcagcacaccaggattcactaagcctgaaaagtgagtggggctgctgaagagatgaagagttaaggatcaccatctttcaggaacactcattcttactgaagacacagtcccaagctgctgcccagatgccaccagcagaatcctactgaaacattgaaactgcccttctaaagtttatacaattaattagggaagaaaggagggagcttacagcacattcagcattaatcattagggagcttgctctctgatctgcttcctcacagctgtttggcgcctattgcctcagaatcacatagaccctgtgacaaggttatatttggttggtgcaaaagtaatctcagttttgccattataagtaatggtgaggccaggtgcagtggctcatgcctgtaatcccagcaccttgggaggctgaggcaggtggatcacttgaggtcaggagttcaagaccagcctggccagtatagcaaagccccgcctctactaaaaatacaaaaattagccaggcattgtggcatgcacctgtagtcccagttactcgggaggctgaggcaagagaatcacctgagcccgggaggtggaggttgcagtgagctaagattgtgccactgcactccagcctgggcaacaaagactccgtctaaaaaaaaaaaaaaaagtaatggcaaaaaccgtgattacttttgcaccaacctaatagctccccttaactgctctacaaataacaaatcattcattgtgaaatgttatgtttttcatttgagatattctttcaggtcctacacaccagtgaaactactgacatcagctgctctgaaggacttcacaagaagctaactcaccaaagaatgcagtttccatatcttgatggtttcatcccttttacccccactaatcaacaactccaattttccagccccttgcctgatggtctccttaaaagccccagcccagaactcctcagggaagtgaattggagggtccctgtctccttgcctggttgccctgtgaacattaaacactttctctgctgcaaaccctgctgtctcagatttttagtctgttactgcacagaaggcttatacacctgtcagtcctgtgacagtaatatgagtcttctgggctccagccacactgtttacaaaacagtttacaaaactgtttctcacagacccctgcattagacacgaccaaagacagtgacttgagttacacggcttttacatttctgtctcatgagtgtttatctgtcagttgtgcctaacacagagcacacacacacacacatacacacacacccatccatccacctaccttggtgtcaaacacgcaaactttctttcttgccccttcccctgaaatgggaatgagaggcattccttaagtactcacaatagtaagcacatatgttacccctcctctaagacaatgttccaagagccttccatatgtctgttccttattatagtcctctgatctaagtaggcctattatcacacccaatttctagataaggaaactgagtcacaatgaggctaagtgactcaccccaggtcacacagctcagttcgcagagacgagcgcactcgcgtgcctactccctccatgagtgtggcaacaaggagggtatggactctggagactgattatgtgaataaaacctggccctgctgcttgtaagctgtgtgacttgggtgggtcacttaactcactgtgcctcagtttccttgtggatacagtcaaggtagaggcagcctacctggcagtaggtgctgaaatgacagtagataaaaagatcatgctccttcagcatgaaagggtttcaagtggaaagctcaattcttcttctaaaaagttaataggatgaagttagagggttcatcagtctactcagcatctaaaccaacacactcgcaccaaggctaatgtcatcatgacagttttcagcccacaggtgtctcctgatttaattatcaagagagtcccattacttggtatatgaaagtgagataaaaacctatccaaggggcattttcttcggcttccatttttggatattggcacttgctgattcccctctctgccttgtgctaccttcttcccttcctccttttcctcacccagttaatgcctcacttccttagaactccagccaaagagtcaatgccccaggtatatctaccttaatcttctaaggctagttcagagctccctgttacatgtttgcatagcatcttttatttttccctgagttcttatcacaatttataattatatataaatatgtgtgtgtgattatctacttaataaacatctcttctattataatttaagagtaatagaactgagacaatctttatttttacttagcatttaatatccatggcatagtacttgcacatagtaggcactcaatacatgcttacagagtagatgaatgagtaagcatatgaaaaaattaaaaaatctgaatgaatgaatcaccaaagtttcatcaaaaagaatttgatgtcctgtaatgacttcgattccctgaaatgtcttggttgctgctggtgccatagactttctggacacccaaggaataatatttcagatagactcatgaggtttccaggcttctgcgaatcaaatccagcccagcccagcccagccttcctgggaagtctgtatttaagtcccccagtttgatttccatcatcatccactgcaagcgagagcagttgattttctttaattaaggcaggaaggatggcttcctgaatgggtaatatatctcccaagttcagcatttcatctgcacagcccacatttcactcggaaatgggacagattcattaaaagtatggccagacagcttcctctttggttgcttgtttgcctacctttaatgaatgaatacataacgtgcctattcattaccaacttttgagtggaagtaattgctgggttccctcgtttgcttggaacaatgttctttgcatttgaagtgtcttctgcctcagtcaccacagtaattcccaatcaatgggccaaagacaccctccaggggcagatattcacctccagctcacctttgagagaagtaatcactcttctagtcctccagggcctcattcagtgcactaggaatgctcatttatggcaggagaccctgggaccctaagaagtaaatgagactgggaggcccattaattctctgagtacaccctgggggcacctggggcattataatgtaattactactaagaaagactaaattccaatgtactttgtcaaaaagcattttacagaaagtactcagtttggccctccctatgatcatgtgcttaactttggccacaggaaatctagggggccatttgggtgactcttggttgactcaaggtttaagggacccttgagactttatccctcatccccaaatcattaacaaacatttgccaagtgcctacactgagtataaattaaagattactgggtccctcatctgtatcctggacctgtacaacacagctgttctagtggtctcccagcctccttcactgcctccgccagttttattttctccatgattgcacagtggtctttccaaaacataaatgtcagtggctcacgcctgtaatccaagcacgttgggaggctgagccaggtggatcatttgaggccaggagtttgagaccagcctagccaacatggtgaaatcttgtctctactaaaaatataaaaatcagccaggcatgatggcatgtgcctgtagtcccagctactcgggaggttgaggcaggagaatcacttgaaccagggaggtagaggttgcagtcagcagagattgcgtggctgcactccagcctgggcaacagagtgagactccgtctcaaaaaaaagagaaaagaaacacaaatgccatcacaacagtcccctgctaagaatcccaaggcttccccttgcccccaggattcaggacaaagtcctcttcctgattcacaggaccttctttgtgcaatctggccagttttgtatccacctaccttctgtcccactttgtaagcatctgcctgccgtatgaagctacttgcagttctctgaatatattccacagttcccacctcgatgcctctgcccacacattttcctccacctcctccctatgaccatcttgtattatttgaaacgctagatcagattcagagccctagaagagagaggcaggttgcatcactttacgatcagagccatgagtaaagtgatagggagtggtgaggaatgggacaaactggtgagcacacgccctctctgtgaggggcagctataccacccagcaatatctaattgttgccatgaaaggatgtgggttcagtgttttcatatccactactttccaggagaagctgaaaatctgaaattttatctgaaatattttttaaatatggtatactccatcgtaacttttaaaatgttaaaggccttccaaagtgggcctgagctcttaggtgctagctgctgactcttgacctctacccaacaggggacacctccttggtgaagtcatctctcctttgtgtcaacattataacttgtggctcaaggaagagcttcagcgaccaatctttgtgtctctgaaagttggcatagtacatggcacacagtgaatgttcagaaaatgtaggataggtaagccaatgaataaataaagtcagtttcttcccccaattggaagcttataaatcacatacacttcaaaaaggctgggggatgttggtgtatcctttttaataatcaggcaaaaaatggttttttatagccagccttcaaccccggtcataagagaagttggcatccacttgtgaaaagcaatttgagagagaacactcagtcctgctgtctaaaaatatctatcacctataacacctgcaatccccaacgttatcacctttaatgggttacattgtagaatattacctttgcaggcatcgttgggaactagcccttccctggcaggaaatggaagaagtgttgtcagctcctaaaagttaatataaatatataccgggttcttttccaatatattctacaaaattgctgtatgactttaggcaacttcctttatcagaaccctactttccccatttataaagaactattctgggccaggggaggtagctcatgcctgtgatcccagcactttggcaggccaaggcaggcggatcacctgaggtcaggagtttgagaccagcctggccaacatggcaaaaccccgcctctactaaaaaacacaaaaattagccgggtgtggtggtacacgcctgtagtctcagctacctgaggaggctgagggaggagaatcacttgaacctgggaggcagaggttgtaagccgagatcgcgccattgcactccagcctgggtgacagagcaactccgtatcaaaaaaaaaaccaaaaaactatatatatatatgtatgtatgtataatttttttgagattctctctctctctctccatatatatatatatatatatatatatatatataattttttggagactctttctctctctctctctctctatatatatatatatatatatttttttttttttttttctgggccagtgtctggggtcttcatcattattattatatggtgtgcaatgaaattagaaaactgctatcttagaccaggttagaaactcaaatatatgtaggaatgaagaaagagaacaataagagctgggaggggaatttggcaaactggaaagctcacatccttctggagggaagagccgctgttcaattccagctcactgttgccacaagggagggtcagctcagagctacctgatcatctgatttttaaacagaagccagaaatccatgattttatgtaaaatatcccaattgcttactaaatcacctgagcaaacaaacaaaaacagtgttgccaaaacaaaacatctacatggactagatttaatctacccatgaaccaatttctgggaggtggggaatggaagtgggctcaacctgtatcacatgtccacctcccttctcatggttccttaagtcacaatcgaaagaaagcagacaaaagctacaggtgggcggggtgcagtggctcacacctgtaatcccagcactttgggaggccaaggtgggtggatcatctgagatcaggacttcgagactagcctggccaacatggtgaaacctccctctactaaaaatacaaaaaattagtcgggcatcatggcaggtgcctgtaatcccagctacttgggaggctgggggaggagaaccgggaggcttgaaccaggaggcagttgcagtgagccgaggtcgcgccattgcactcccacctgggcaacaagagcaagattccgtctcagaaaaaagaaaaaaaaccacaaaaacaaaacaaagaaaaacttcaggtgtctgctacaaggcacaaatcaaaaagactaataccacttgagcttcctactgttttttttttccttgagtcatgcattatttagcttgaaattggttgatttgaaaaagagcccctatacctattataagcagatcttcccttacccatataagatttctgtagcctatttccaagaaggaggcagccattaatgaaccgtgtgttcccacctctgggtcttgccagccatagagcaattctgctcaaggagaccctggttcacttctcggtaattctgacttctcagggaccggcttttgtttattttccttcctcccaagcatacatatttcatctggcagcttttccacatcagcaaaatctgtcgtgccagcaccagattcctcttgtgcacaggctccatcctgattaactctatttatataatttattttggttgcccgtttcccgtttgggagatcgatacaaatttaaatgagaagcaagagtatttacagccacttcaagcgttgatcaaacacaggccaggatgtggatgttctgccttggagatgagtccctctgtgggatcatcttggtatcatctcacaaatggagagaaatggagaaggagaaaaggaagcagacagaggacggaaaaagggagggaggaagaaaagaaggaaaggatggagggaggaagaaaggaaggagaaaagagaaggcaagaaaaaaaaaaggaaaagaaaagaagtggctagactagttttccagctttccagctcagttggcaaataccaagcacttttagccttcggctcaacttttatacacatatctgcatgctgagacgtgtctagaagtaagtcaccaaagtttttgcttatattagttcccaagtaaagcagaagacgctgccagcttatttgtgcatgagtttttagctgtcaatgcatatttcaaacagcaggcaggaactgactgcataaatcaagctctgcggggatctgctgcccttcaccaggctggtgtgtgatccaggatgtgatttgatttttgggctttctccttagcagaggccagctcaacggcccagccttcatgatctggaccaaattgtgtgtatttcggggggtggagtagcgcatccttttgttgagctggcactgcctccttttctttagttctcagtttggacactgcctgctatttcttttttttttttttaagaggaggaggtggctgtaaaaagtgtttctccaagagacccatgtggtcaaggagcggaatgaggagtgagtcaggaggcctttgtcatggtttgactctgactttcttagaatgaactcagtcctattattctctacccagagccaactgtagcatctccacccatggggaaggctatggtttatttaatcaacagaactggtccatttggctctccattggtccattctgatgtacagaaaacatggatctgtacatcaatcagatacaaaaatcaattctgaatagattaaatatgtaaatgtatacaagaaataggaaagaaagtaagaggctctatatataaagagttgtttttatatggtctttggttgaacagatcttaaaggaccaggatgggggaagaccttcctaatctagacagaaagtccagaagctatgaaataaatggttcacaaactgattacaaacaggttgggtgtggtggctaacacctgtaattttgggaggctaagacaggccgataacttgagtccaggagtttgagatcagcctggccaaaatggtgaaaccccttctctactaaaaatacaaaaattagccaggtgtggtggtgcacacctatagtcccagctacttgggaggctgaggtgagaggatcacctgagcctgggaggtcaaggctgcagtgagccaagatcgtgccactacactccagcctggctgatagagtgacaccctgtctcaaaaaaaaaaaaaaagaaaaaagaagttaggaaggaagttaggaagaaagagaaagaaaagaaagaaaaggaaagaaagaaaagaggaaggaaagaaggaaggaagaaaaagaaagaaggaaagaaggaaggaaggaaagaaagaaagaaggaaagaaagaaagaaagaaagaaagaaaggaagaaaagaaaagagaaaagaaaaagaaaactgattacaaacaatgtattttaagatctgttagactggctgggcatggtggctcacacctgtaatcccagcactttgggaggctgagacgggtggacaacctgaggtcaggagttcgagaccagcctgacccacatgcagaaaccctgtctccattaaaaatacaaaattaactgtgtgtggtggcgggtgcctgtaatcccagctactcgggaggctaaggcaggaaaatcgcttgaaccagggaggcagaggttgtggtgagccaagatcacaccattgcactccagcctctgcaacaagagagaaactaggtctcaaaaataaataaataaataaaagagatctgttcgaccaaagaccaaataaaaacaaaagacaatgacagactgggatggaacatctgcagtacatatggtgctcaaactgttaatattcctaataactaaagggttcctaaaaactgaaggaagaagataacccagcttaaaattggagaaaatatatgacccggtaatacattaacgggaagccatgaaaacacttaccccaatccactgatgagtggaaaaatggaaactaaggcacctatatggcaccatttttctcccattagtgtggtaaaatgtttaaaaaattaataatctcctgtgctggtgaggatgttgcaagggaaatggccgtggtgcagtcaagagtaggctgaggtaaacatgcggcacagcatgacgcagtggaattggagtgcaggctcacaatcccgtgcattacataatcacagttatggagccatgttatgggagggctcatcacctgtctctgagccacttttgttcgtgaggtgcataaatacatcactaacactgtgagaggggggtcgcataataaagccatctgtcacctgcctaaagctccctccaactcaagtggtctttcaactacccaccacctgtccaccaactccccttgatctcagcttgggttggaacctgacagatgtggagaaatggccatgacagcaacaaatggctgaaactgcaaatttattttgcaacataattaatgcaatatgtattaaaattcaaaagattcttatcattaagccagcaattcccttttttgaagcaggtacaggagaaataaaagctatacagaggtttatttgtacaaggacatgtatgcatattgtagcattgtttatggtgtccccttccaaggagagaaaaggaaaggaaaagcaagacggagcggaggcagactcagagagagagagagagagagagagagagagagagagacggggacagagagagacggagacagagacagagaagaaaactggagacattctcaacaaatatttagaataaattaaaagcaataagcattaataaaataggataaatatttgagataactgatgtggtcatttagaggaataagtcagatctatgtgtactgtcatggaagaacagcaatgatttgatagtaagtaaaatgcaaaaaataacccacaatcgcaaagcaataacaaaaagtacagggtaacagacttagcttaggttagttcatggtactgagaatgaagtttctaaggccagcctacttggattcaattctctccttcggttgttagctctgcaagctaattaacctctctgtgtctcggtctcctcatctgtcaactgagaaaattactggggcaattagatgagttcatcatgtaaagtacttagagctgtgcctggtaagcttcatcatcatactcttactattgaaagggtgctaatacagctgatagcctgcagttaggcaaccttggggctctagtcattgccagaacactgaagtattttcacaccagctggtaaagactgtcccccactattctgattattctaggcccttccctaggttcaaccccttactccaggcatccccatggtctagcaaataaaggtttaataccttggcttcccagtggtctccagattccaactccagcctaaggcttagaccccctgccaatctggctttgaattctgcatatcacctctaacaacagggatgtattacctgtgtacatttttgaaaacaatcaataaactataacagggaatataatgcaagcctacatttctgcatcttggtggcattcaccaaagccaagcctggcttctgtgatttgcaaatggctgccttctcctcctccacccttccctcacagagggaagtaattcaaattactctctacctgaagctagcatggtaaataattgaacctctaaaagaatataaaggcttaaaaaaaaaaactcttaaatattacctacacaggttttactgcaacctacagggtgtcttcctcaaattcactgctcaaaatctcttgagccccagaagtcttttagaataataccaggaaatgaatacccacctggtaatgcattataatttctaggtctggctgtgatggaagccaagtccaggtttgtacaagttggaaaagaataaaatgtccctggttacaaataaatagctgtgccaataacagactttaatgtactatatccccagaagcctgagaggagagaaatgagcaggacgatgagataatcggtctaaaagggcaaatcaagcccctctaagctggctttttttataggtgggcttgtaaaataggggtggagaaacttctgcttcaaaagcaagaacaatgaaaatgaaagttgctatttcaagactgaaaatatgtgctcaggctacagaggatactctcccagggcccatttcacaggtgaggaagctgaggtgcaggacagttaactctcttgcccacaggtctgaaaagcaataacatttgttgagcagggtgtgaaagcaggtgcctctgtcactacagttcacagaagtctgtaaaatgagacatatctgtctcgagacatagggacacagaaagatggtgagagagacaggtttatgacatgttttgtgatcggattcatttgccagagcctctgaattaaagattagaccagtttcatggctagctcatgtcaggtctggattcatttagggctggctggttggtttgttgattttgcagggctgagtcccttcccatcaacatacacacgtactcctgccttgttcaggccacctttacctgctctttgatgctgcctatgcagcgagtgagttagaggtgaaattgctgctaactactaagagtccctgcccccttgcaactgacaacagatgacactgaaatgaaagggaggaagggaagacctcatgagttcctggtgcttgtggaaggaggagatgcattataattatatttatacaaggcagcgatacttcacctcctgaaatcgttaggcaatgttttgtttatatgctcctatgttctgggggaggattttctggggagagcctccctcaaattctcaaagggatctgtggcaccaaagaggttaaaagtcgattgtcatgggtgtattagtctgttttcacgctgctgataaaaacatgctgggtaatttataaagaaaaagaggtttaatggactcacagttccacgtggctggggaggtctcacaatcacagtggaaggcgaaaggcacgttttacatggcagcagcaagagagaacaatgagagccaagcaaaaggggaaaccccttataaaaccatcacatctcctgagacttactcactaccacgagaacagtatgggggaaactacccccatgattcaatcatctccccctgggtcccttccacaacacgtgggaattatgggagctaaattcaagatgaggtttgggtggggacacagagccaaaccacatcacatagggtctgtaaatcaaatatgtccggatagtcatccccattcagtccttctttcattcaacacataatgagctcctactatgtgcacatcagggtcaggtacagggattacactggtgaatccttccttcatggaccttatattttagttggggacacagacattaaagaattcatccggtgactcatggatatgatggtgttaggagcttcaaaaagcaaggaggaagtgaaatgaggacctatttcctagtacactctgggttagggaagacttccttgatatagtgatatttaagctgagctcagaagcatgagcagttagtggggaggggagggttgccggaggagtgttctaaaccctgggtgcccagggggatctgcagaccagcagcatcagcaatgtctgggaactcattagacgtgcagatgctcaagccctgcctcagatgtaatatgtatttttttttttttaggtggagtctcactgctgtgtcacccaggctgtagtgcagtggtgcaatcccggctcactgcagcctccgcctcctgggttcaagcaattctcctgcctcagactcccgagtagctggggtgacagatgtgtgccaccacgcccagctaatttttgtatttttagtagagacggggtttcaccatgttggccagactggtctcaaactcctaacctcaggtgatccgcccacctcagcctcccaaagtgctaggattacaggcgtgagccaccacacctggcctaaaatcttaaaaattttaaaaaatactttcgacttttattttagattcagggagaacatgtgcaggtttgttacataggaatatattggatgatactgagatttctggtataaattatttcatcacctaggtagtgaccatagtacccaatggttagtttttcaacccttgccctccttctctcccctctctagtagctcccagtgtctactgttgccatctttatgtccatgtgtacccaatttttagctcccacttataagtgagaacatgtagtgtttggttttctgtccctgcattaattggcttaggataatggcctccagctatatccatgttgctacaaaagatatttcattcttctttatgactatgtagtattccatggtgtatatgtacatatatggtgtatatgtacatatatggtgtatatgtacatatatggtgtatatgtacatatatggtgtatatgtaccatatgcatggtgtatatatactatatactatgtagtattccatggtgtatatgtaccatattttctttatccagtcccctgttgaagggcacctacatagattctacatctttgctattatgtatagtgctgctatgaacatggaaatgcatgtgtcttttctgcagaacgatttatattcctttgagtatataactagtagtgggattgctgggtcaaatggtagttctattttaagttctttgagcaatcttcaaactgctttccatggtggctgaattgatttacgttcccaccaacagtgtacaagctttcccttttctctgcagcctcgccaccatttgcagttttttcactttttaataatagcctttctgactagtgtgagatggcatctcattgtggttttgatttgccttttcctaatgaaaagtcctaatttttaacaagatccctaggtgattgatatttgcactgggggctgagaattgttcctctgaagagaggcaggagtatttgaggaactgtaggaaaactggtactcctgaaactcagaaagaggaggaggtgggggagatgaggctggagaggcaagagcagagacatcagattcttgtagccatgttaagaataaaagaaatatttgagggcaagtgaatgattatgcttttggcaagaactttttttaaattaaattaaattttttaagttccagggtgcatgcatatacaggatgtgcaggtttgttacctaggtaaacatgtgccatggtggtttgttgcacctatcaacccatcagctaggtattaggcccagcatgcattagctctttttcctaaagctctccctttcccacctccaccctcccccaacaggccccagtgtacgttgctcctctccctgtgtccatgtgttctcattgttcagctcctacttataagtgagaacatgcagtgtttggttttctgttcctccattagtttgctgaggataatggcttccagcttcatccatgttcctgcaagggacatgatatcattcctttttatggttgcatcatagtattccatggtgtatatgtaccacattttctttatccagtctatcactgatgggcattttggttgattccatgtctttcagcaagaacttttaaaactctaatttggtagcttgggctatggggtttatatgtagaatgactgagggaaccagcttttgtttgtggtcgcctatccctccttctgcacattccacgcttcatctctgttttctcatctgtaaaatggggataacaagtcctctcttgcgcagtccttgggctggttgaatagattgttccctataatgcacatatgtcaggtccagtgcataagaagtattaacaaatgagtttacttctcattgtttcaagaaatatttgttccaattatttattctaagccctgaaataggagctggagatgttacactgaacaagatgtgacagcctcagggagcccaaaatcactctggggaaactaggactcaaatagatgatatgatagatacaataacaggcaaagtacaggtgccagtaagaatgtaccaaagatgggtaacagaatccagggagcctgtccaatgcttcacagaggaaaggatatcgaggctgatgccaaagaatgagttgaaattagccagacaaagaaaaggaaggtctgcacatggcagaccctacttgacatctacaacatccagaagcaacgagggatagctatctagaatatacaaagaactcctctaaattaggaagaaaacagagtaaacccaatggaaagatacaaaaaaaatcatcatcagatgattcagatatggagaaacctaaatggctctatgacctatgaggagatgctcaacctctttaataaccagagaaaagcaaattataacaaggcaccacttcctacccatcagaatgacaaaacagtagaaagatggcaaatgccaagaagcatgaagctgtaagctctcctttcttactggtgcgaatgtaaactggcaacaccatttggaaaagttatctggtgagtcttggtcaacataagtatgtgtgtgccttactgcctattaatctctctcctaggtatataccctaggggaatgctcacatactcataaaaggatgaatttaaggcatcaactttctttgtagcatcaagaagttgcaggcaactcaggtgtccatcattaggggattggctgagtaaagtgtgacagatgcacattatagaaaatcaaacagcacaaggaagtcacaagcaattttatagaaagcaaattatacagaaagcaatttggatagatcgtcaaacaatgcggaatgaagaaagcctcagaatggggtttccaacacagtgctatttatgttaattaaaaacactcaccatcaaagtaactctgcatattttataatatttacaaacacatgtctaacacatgagaaagggttcccctaggggaagagaaatgaaatggggactaggtatatagaggaagaaataaatgaatagtaaaacaagacaataattgaccatatatgatgatgcaccataggctaggaaatttgactagctcaacttatgcttctgagatccaataaataaacaaagtatcaattaaaatggaagtgtttcaggcaaagggaataatgtgcaatttgcagaagtaatggaggacatgatacattctggaatggagagagatcagtagaattgggacaaataacataaggcaggaagtgttaaggaaagaccagacatgaagaaccctaaagctatactaaataatcaggattcagcccaagggcagtagggagccattgtagtgacatgattgtgtttttaatcttgctccaagctccaacaatgagaaaataagccattccgctgagtcagaagcgcatgacatttctcagtattcatgtggcatatttatcaagtattaatgaaataagccttgagcatcttagcacccaactcatgaacctcatttttccccccttttataccaattatgagatagtcatcgacactttcaccaataaccaggcaacatacagaaccacatttactatttgaccttgggcaaagtcatctgaactccaaatatgagttgccttaatttctttatcagtaacaagaccacaagcatttcctatatccagtagccactggaatcaaacagaaagtgattttacatcttcaaaataaccttatgagatagatagtattcacattttataggaagaagaaaccaatatggagacagagatgttaagtaatttgcctaaggtcattaaccattaatagatgcagaagcacgcatttctgtttacagactgtttaagagtctattctgcgaaccacacctcatggtaccacccttagatggtagtgcttccttcaaagtttgtagcattggaagaccttctgcaaacagtgtgtttggcaacactggagcctagaaatcaatctcaaatgaatggcctctgagctactttgggactgtatacgtgttttctttaacccaagtaattttcttttttaaattctgtataatagcctatattttgaaatctgaagattttacgtagaaatccaaaattttggtttctggtgaaaagttgggaaatttgccaagactgggctcccattccctttcagaaaaatccactggagctgagtagcagctacacatttagagagggcatatgctctccaattttccacagtccccacccctccctaatacactaagctcatttctctcattcccattaactgcctaggcctaatggaattcaatgttatgacctctgttgtagggaataaatagtctaatcaccgagaggatgggacgagccaaggttttaaaaatccaaagcttgatctatctcagaatgaaaatgaaaattaaaatctttctggagatttatcttcctggtctcaattctcattggtcttttccccctttgacctttaatttcatttattatgaaacagccaagtggcacaacagaaaataccatcaaaatgtgagcactggggttgttccttcagaagctgaatgttaggcctggcttttccaataactctctattcattcaaatctaattacaaaatgatttttaatcattgtggaataaattcactcttcacatctagaaatgttaaagccctaatttaacagcaataaccaaaaaaaaaaaaaaaacaccctctaatggatttgcactaagaagcagaacatggcctgtgttgtcagatgttcaataatttaactgcaaatgaagtgtgtaaaatacaatatttgtgtcataaaccacccagcttgtcacataatagatttttgaagagtcatgtttcacggcactgagcaatgttatgttggaatggtggagtagccaaattgaggtttaaaggttccatttgcttatgcagaaagtgattgagtctcacttcacccagtgacaggaagcatggaaatacagtgtctctggatcttaccatttcaaagcagtggctggaattcatccttccagctagataacgtaactcatgttcaaccttccctatgttacaagatgtattttggattaccttacaagtctagtgggatattgtggttcctttgctatcacaggccatggtaggcagaacaatgtcctccccaccatcccatcttaaagatgtccatgtttgaatccctaggacctgaaaatacattgggtggcctggaaaagggggaattaaagttgcagataaaattaaattgctaatcggctgacctgaaaacagagattattcagatgggtctgatgtaatcacaaggatccttaaaagtagaaggaggagacagaagaggcaagtcagatggagatgagattatggcaggtcagggtgatgcaatgtgcaaagaactttactttccatttctggaaggagcactgactttccattgctggaaggaggatgggtccacaagccaaagaatgctggtgccctctagaagctggagaaggccaggaaacattattccctagagcctccagaagtgcagcagccctgtcaacaccttgcctttagcctagtaagatttttactggacttctaagcttcatgactgtcaggctaatacatttgtgttgcttgagccacttaggtggaggtaattagctgcagcagcaatagaaaactaatacattgataccaaagccatatctgtgggaaaataacagaggaattagaacactgccttcttttgctcaaaattagtagactaagatacaaacaaatgatgttactatatttcttcaattttactatgcatattcgtttttcaaattatacatttctcacattaggatttatctcacaattgaagaatacattgaatagagtgctcttccccaagtcctttcagcaaaattgaaagctgtcactaaatagactgtacgttgtacaatcttgagtaccccaaaatgacacaaaaagtgttcatcttaaggagtgagcaggtgaaattcaattcaacaagcattgattatcttgttagtaccaagcacgctgctaaacactgaggtaggccagacattgttgtttttgtgactttcacaggcaaatggaacaatgacctatacatgataaattaaaacaaaaactcagactgatgctatgattaattctccaaatgcaaaatgctgtgaggtcagggcctgtgcctgcctagttcatttccaagtcccctgtatctagcatagacatggcctagcacagggtaggtattcctttgaatgattgtctaagtgctttacatgctttatcttatttcctaccaggtggattatatggtgtcttcattttacaactgagggaactaagtttagaaagagtaattcatttccccaaagtcacacagctactagcagcttagaccagggcttctcagcatcggcatcattgatatttgagctggatcattctttgctgggggcaaggggccaccctgtgcattgtaggatgtttggcagcatcccctggcctttagtcaccggatgccagtaacacactctactccacttggaacagtcaaaaatgtcttcagatgttgctgaatgtccctgaggggaaaagggcaaaattgcccccagttgaaaaccactggcttaagcaaatgggcattaatattctaagtatgtgtgcttttaaaataacctccacaaaatctctgatactctccttttagagagttggagcccaattcctaccctattgagtattgagagaacttagtgacttgcttctaactaatggaatgtggcagacacaaaaggtacacacacgattaggccatagaaggcattttggccttctctttgtcctctctcttgaattgctggttctaggggaagttaactcccacatcatgagaatatataaacagacctaaaactctacatggtgaggaactgaggcctcttgcctacagccagtgaggagccaagctacacaatctgttgctatggagtaaactgtcatgggagaagtgcctccagtcttggttcccagttgaaccttcagataagtgacatccccagctggctgatgtcttaactgcaatctcatgtgaaacccagagccagagccacccagctaaaccactcttggattcctgatgctcggaaactgagtgagataataaatatttgtgttttaagctgctgagctttggggcatgtgtaatgcagcaatagatcacaaagacgaaaatgaatgacctattgagggaaaaagtaaatggtccagaatgactggtgtgtggggtgcatggcagaggagggcgcatgggctcgaggatacaaacagaggcagagctgaaggatctgagtgctttgtatatatcagggaaaaatggggaatcagaactttgaggctgggcatggtggctcacacctgtaatcccagcactttgtgaggccgaggcaggcggatcacctgaggtcaggagttcgagaccaggatggccaacatggcaaaacccccgtatctactaaaaatgcaaaaattagctgggtgtcgtggtgtgcacctgtaatcccaagctacttgggaggctgaggccagagaatagattgaacctgggaggcgtaggttgcagcaagccgagattgcaccaccacactctagcctgggcgacagagcgagactccgtctcaaaaaaaaaaaaaaaaaaaaccctttgaggattatgtagcacagaagttggcaagctatagtccagtggctcaatccagctatttttgtaacacccttgagtgatgaatggttttacatttttaaacattttccatatattttccccaaaacaagggaaacaggaaaggccaagaagggccagtttgcaaagggacttgaatgcaggctcaggagtctgaagttctttctagagacccctggggccataaaagagcaacaggacttgtgcatttttcatttcttaaaaacacaaatctgagcacatcattcttgtgtttgtttcccaatggcttcccgttgttttaagcataaagaatgaacactaagaaaatgagagatgacctttcattttcttcctgctgcctagctggtcagcctaattttctgccattgctccagtattgtgcccaacacacacacacacacacacacacacacacacacacacacactcacacacgtagatgcattccctccgaacagtccttctatcccagacatttttagttctcttacatactgggttctactgggactttgtctttgtcccaaatacctctccccatccctgccttttgggctacctatactaattgcccctttttttgaaagtcttcctgcttgggcatggtggctcacgcctgtaattccagcactctgggatgctgaggtgggcagatcacctgaggtcaagagttcgagaccagcctggcaaacatggtgaaaccctgtctgtattaaaatacaaaaatcagctaggtgtggtggcatgcacccataatcccagcaacttgggaggctgaggcaggagaattgctggaacccgggaggcagaagttgcagtgagctgagattgtgccactgcactgcagcctgagtgacagagtgagaatctgtctcaaaaaaaaaaaaaaaaaatcttcctatccttctcagtctagggaggtatggctcccatacattcccattttagtctgagtagatgtttatctccacactcatgagactgttttgtatttgtccatttatgcaattttcctccctatctagatgagagctccatttattagctgcatattttatctctgaaaatggtaaatgtctaataaacgtttgttgaacaaagaataaagaaatgataactgagttgccgctgagagctgtgtctaaagaaatccagacttctgtgtagtttggtagctgggtgatttgtcttggaaggtttctgaagaaaaataagtccagcattaagacgccttatcttacctgaggtaggtacataccttgtagtgcagctggacataaacacggatatagcagtaacgggtttcattctcttccacaaatcaccggaccagttcccctcagaacagaccaagaggcattaccgttactctgaaacatgacctcatttcactgactcatgggcagaaaccctgagttgctggtccctttccaccagtgtccctaatcttccctcatatgacaggaaaaacaatagctatccataaccctgatcattttcaagcaagtttgcctctgttaaccattgagaacccctgaagagcttgttgtggcatctgtctgtttttgtgaactgggttgggctcaaggatactaacaggcgcagctgaaggatctgagtgctttgcatatatcagggcaaaatggggagtcagaactttgaggattatgtaggactgatgtaggcaagctatatccactggctcaatccagctctttttgtaacacccctgaactatgaaaaatttttgcattttaaaaaaattattacattttagatggtcatatgagtatatatatcatttccttttttttttttttttttttgagataaggtcgtgctctgtcacccgggctggagcgcagtggcatgatctcagctcactgcaacctctacctcccgggttcaagcgattcccctgcctctgcctcccgagtagctgggactacaggcatgcactaccatgcctggctaattttctgtatttttagtagagatagggtttcaccatgttggccaggcttgtcttgaactcctgacctcaggtgatcgaccagccttggcctcccaaagtgctgggattacaggcatgagccactgcgccaggcctgggtacctatctaatttcttaaattttggctcttggcttgcaaaggctaaagtatttatcatgtatggccatttaagaaaagttggctgatcctttatgtagaaggaaagacaaagaagccctcagagttggaatttggagaacagacatgactaacatggaatttttttttttttttctaaaatagggtcttgcacagtcacccacgctggagtgcaatggtgcgatcttggctcactgcagccacaacctcctgggctcaagcaattctcccgccttagcctcctatgtacctaggaccacaggcatacactgccacactcagctatttttttttttttttttgagatggagtcttgctctgtcacccaggctagagtgcagtggcacaatctcggctcctgcaacctctgcctcctgggtttaagcaattctcctgcctcagcctcccgagtagctgggattacaggcacctaccacaatgcctggctaatttttgtatttttgtagagacagggtttcaccatgttggccaggctggtcttgaactcctgacctctggtgatctgcctgcctcagcctcccaaagtgctgggattacaggcatgagccaccacgcccggcctattttttttttttttggtagagacggggtcttactttgttgcccacatttgtcttgaacccctgggctcaagtcatccacctgcctcagcctcccaaagtactgagattatgggtgtgagctgccatgccccgcctagcatagattttaagttgcttacaatggagtgtaccctgtaacacatctcctcagcatcccccagagaacctgtgttatgtgcattggccttgaaggcttgtgagtcagcgattctttggtggaactcagcatatgtgtctgaaaagacagagcatgtagaagaagaggctcgtgaacaaggaagcagctgtcacctggtcacttacagccagtcagttgatcgtcttctgggtctcaggtcaggtttgcaaaggaacaacacggacctatcctccttctcctcttcctccagcctaaatggactccagccagctgggtgtcactgctgccatccttagagagggcttttcccaccttcacataatcaggaggctcctttcttcccgcaggagcccatcagtcgaagtgcacggctgcttctcgcagagagccttcttacccatcaagggaagataatgctctgtgatcattttggtttttccaggcttcatgttctctctctcctttctgccccagcggaaaacgtagggctgctattttaagacatcctttagtaccaaaataccactttgagacactcatgtctttcttttcaataatctcttttaaggtataaagaacttaccaggaggggcacgtggtggctgcctatgggaagcaagctaaacggctgctcagagacctttctggtattcctgctgtgccaggacgtcagtactttccaactcatgattctgaggctggtggatcttccttgtcttcttccatctctcatcttcaatgtcctaggctggggactaagggaaggcataatggggagcccaggcttcatgcagatggaacaccagcatgagaaaggaaaggcagatactggccatgtggacaagaaagcaagacagaagaacagtcagtgaaaatacctttccctaccatgaccaataccattgagtctatagctgaaggtagcattaggggtgggtgtctagcaatatcatacaaactaacagacatttgggtgaataaatcatgagcagagtcccccataatctgcctttctaacgataattagtatttactgagtgctatatgtcacttagtaaatgaggtccggttttaatccgtttacaagattcagttcatttgctgctggcaacgatcctatagcataagaaccattgttcccctgtatttacgaagaggaaattagagctcagagagggtgagccacttgcccactatcacacagctcatgagtggtagagctgggactcagacccaagcctgaccccagaacctgagctcataacctctccttggatgggttcttccaaggagtctgcctccaataaactgtgtcccatgccagccaggcaccagcatatgctttggagaaaccaactcccgtagacatctgtctagatggtgctgatattataaatggtactatgaaaaaataaggataaagcttataaatcaggcaaagggaagttatgattcttctggacaccctaatctatctccctataattgcctgtatatgaaatgcctgcatgaggttatcagagtattccctgagtcgcctgcgaaggtaagactgcaattttagcgacccttgttacacaaaccaaagcaatctgttctattttgacactatgacactcctggcttgcaaaagggatggaggcacggacgggcaggcatttgtccacattcttgttccaaacgaaagtaagaagggttaactgtgaggcatgcttactgcaaatgacagctctggcttctaactatactaagcagtggccaccaatcttggggatacttaagagaaaaccacagctccatttctttaacccatctttaacctttagttctagaaatcttaattaaaaatcaattccattttttttgtagtaaatctgacagtaattctatctctaatggcagtggaaagataaatagtatgtcaggtaaactcagcaggaaaatgacattttcattagcaatttactgggtaggaaattcccgccatgataaagcattcctgaacaatactaggtaaccattcccctagggcagctgctaattaatgggggaacaccagtgggattaaatgtcttctacccaaatgatttgaatcgtcacagcagttattttgaatgtacctgcaccgagaaaataagtcgggcccccaaaacaataaacaaagtgacataacaagacgattgcagcctattgcagtccagaaaaatctaatctggtctcctaacagcattgcaatctttattgtgactgtatgggccccaattcatcagcccatttcggcaagctatccccaccaataatcattcactttcagggtagcctctgaacaggtattgactttagagactagcaattcatcccgggccctctatccctccatcgagattcttcggcagtctttgaagcagacttggaaagaaaaatttggtcctcatgtgctagacccccagagagcttccagggataaagaaaaaagaagacaagcaaaattctccattcaaaaggagaataaaatcctggcatcatatttcatccctgctaaacctcaataatgttcccagtgatcagtcaaatcaaggtagaatcatgaagtattagtaagaaaagggatgtagggttagagtatttacatttacagaggggctactatatgcccagggctccaaataactttctaattaaaacttacatcaagcccattgcaatgtaggtataattattagctttcctttcagataatgatactgagcaacgccctggctgaatggcggggaggactgaatggtggtgatggccaagagcaaagcgaaacagcatttccaacaggaaggatgtggacaggattatagaccctggtcagagcaccgtgatgaggaatcctacttggcttggggtgctgatgtccacagaccgataggggagagactttatgctgtgtatctcagataaggcaaagggaagatgtaattagattttactatggagtcataatttcagcccacagaaaacaataaaagtgtcaagagggccgggttcggtggctcatgcctgtaatcccagcactttgggaggccgaggcacgtggatcacgaggtcaggagttagagaccagcctggccaataaagtgaaaccctgtctctactaaaaatacaaaaattagccaggtgtggtggcatgcgcatgtagtcccagctactcgggaagctgaggtgggataattgcttgaacccaggaggtggagattgcagggagccgagaccatgccattgcactccagcctgggtgacagagtgagactccgtcaccaaaaaaaaaaagcgtctgaacacagctctcccttttgcaggaatggttacctgatattctcttcccaccaggggcttggctggagctctgaagctgaagtggatgccactccgtatgatttccatctgtacttattaatggtgaataggagtcagttatgtaactggcatgttcatcacttcgtatgctgggccccacaacccatttctgaaagggcttccatagagcctgctgagtgtataatgagactttggttctacttcttgcccataggttgggccaaggatagaaacaaaattgaaatctgagttgggagaaccaaggtatcacttggggatgcagaatatggtccaggagctccacacagttgctgttgggcccttgactgagaaaccggacaattctgaggcttgcccggctcaaccggacatggccgatatgcagagagagagaggaaagaagcagacgtgcatgcagaaaggcagaaggagacatacccctaagatggccatgtgctcctggcctctgaattcccaattccaggctcctgggagatgtggctgaaattcctgcccctgaattctgaaggctgcctacagtatttgttgggttgcttctggttccaagtgccagaaaaatccacataactcaaactagttaagtcccaagggagttgaatggctgacagagctgcaaagaccaggcacaaatggctgcaggtgcccagaccatgtcctcacggttctcctctatctcttctgcccgctttcctctgaattggcttcattctccaagttgggggctcaccaaaactcccagaagttctggctttgtaacagcaatggagaaaacaccccacgttccaagcaggtttagaaaaactgggaggctgaggctcactggatggtttggatcatctatctacctatgaaccaagacactatggtcctccggtcaatccacccttagaactcagtggggagtgagtgaggccccacccagccatgcagactaagagaaagcaaaggaacactgttcaaaggggacagctggatgctgttagcagagaacgaatgctggcaggcaaagagcaggaacatctaccatgtcccagccccacttcaaagaaacccgtgttttaagttactctgagcaggtttctggtttttgtcaccaaacagactaaatatttagaaaaatgtgtccaaagtgctatgtgtatgtgagggggagggaggggaataaaaatgagtaagatagatttcagtggtcaagccctttaccattttgtagggaagataaagccaatatatgtaaattatacatcacaagaaagagcttgtttcaaggggatatagaaccccaggatttcaaaggctgtgatactggctggtcaccagggaagtttctggtggtattaactttgtgtggtgattacagaatggtgagggtttgaaatagggagaatagttccagtcacagaatggtgtcatcaggccaggggcagtggctcacatctgtaatcccagcactctgggaagccgaggtgggtggatcacaaggtcaggagttcaagcccagcctgacaaacatggtgaaaccccgtctctactaaaaatagaaaaatgaggcgggcatggtggcacgtgcctgtaatcccagctactcagaaggctgaggcaggagaattgcttgaacccaggaggcggaagttgcagtgagctgagatcacaccactgtactccagcctaggtgaatgagtgagaatctgtctcaaaaaaaaaaaaaaaaaaaaaaaaaagaatggtgtcaccaaacatttagaggctgacaagtatgaggtatgcatagagatgatcaaacttacccctaaatatctcttgcatctatttctccccagctttctcactgccagcccagtctaatgtctctctcaaacttctgggacatccacgcttgctctatgccaatccaatttccacttgtcaaccagagggatatttggcaaatgcaaatttggtgagaattatgccccccctgcttctcagtgagtttcccattgctctgatgatcaagattaaaattattttccagcatcctcccttctttgtcacgccagcccatctgctcttctctaagttctacaaattctgcaaagcttcagattcaccatggagactgccagaaatgctcctcccatccctggtccctttgcagtgtgatttgttggtgcccttcttgcagatacccccatagggaaggcgatttcacctagggaagttcaaatttccttgtgaagcacgcatactgtcacactgtatttttctttattgcttttatttcagtcagtgaataaatatttgtgtgattatttcattatgatgctttcctctacaacaatgtttcttaaccttgactctattgacattttggaccacgtcatttttttttgttttgtatggggggaatgtggggtgcacgggggggactctcctgcacattgtaggatgtgtagcatcagccctcgcttctatcccctagatgctagtagcacaccctcccccagcagtgacaagcaaaaatgcctctggatgtttcccaaacatctccctgggtaggtgagtaacattgcttctcccaccttgaaaactactgctgtataatttttttctttctttgagacagagtctcgctctgtcacccaggctggagtgcagtggcaagatctcagctcactgtaacctctgcctctcaggttcaagtgattctcctgcctcagcctcctgggattacaggcatccaccaccatgctaggctgatcttttgtatttttagcagagaagtggtttcacgatgttggccaggctggtcttgaactctcacttcatgtgatccatccaccttggtctcccaaagtgctgagattacagggtatgagccactgcacccggccactgctgtataatgtatactataaagtccatgaggaaagaaatcagtccaaagcctgataaacgtaggcctgaggctctcaactccagctgcactgtagaatcacaagagaactttaaaaacattctgctgcatggtctgaccctctatcaaataaataggaatctctgagaaagatggagaggggagattgaagcccaggcgtccaaaggaaaaacaaacaaagcagaaaacttcctaagtacatctcttgtgcagctagggttggtaatctcagaagcaggcatccatggttggaagctttgttgaatgaatataagggagggatggagagagtgagggggtgagatgagaaaggaggagatgcagggaagaaaggcaaaaaggggaagaagggagagaaagaaggaggaaagaaaaggaattgaagccaaagaagggaaaaccaatgtttctcattagacgaggactcacaaaaagaacctggttatgaaagctggaggcctaagttgcgagcacatttgaagagctttgaatatcattttgttgtagctggggtaagcaatgcaaagccaacaaaaatttcagagcaaggatgcttcaagttccaagcagtgttttaagaagtcgagtgtgttacacccagcacaaaataaaccagggtggaaagacccgggaataaactgcattatatgaaataattgagagtggtgagaataaaagtgaaacaacaaacaccaaagattccctacagcaagataacctggtgattatactccctgacaagtgcagagactgccttttggggacacagccttgtccctgtcattcttagtttagtaactaaggcagacagtgaaaaacagttactaatgtcgtatcagtaaggaagaagcagaaggttccacgggctggagcaggtgcctcccctgatctcaggcttcagaaaacacttctcagagggaagcagctataagttagcatacctcccagcggggagggggtgggctggaagagtgagggagggaggtacgggaactaggaaaagagaactggataggggagggtcaagagcaaagtgaaacagtgacagatgagcaagagaagcccaggaggatggtggagtgcctcgtaagccctattcaggattctagactttccgctaagagtcgaaataacccacagagagaagggttttaagcaaagtagaagcatcatccagatttgcatttttttcagatctccttttcgctgtgaaatataaaacagaaacgtggatgaagagagaagctggcaaaatgtttccaaggctttaacgccacctgagttggaaagagaaatgtgacatgagcagcaatgcagagaggcagccagtgaccagagttagggacaagaaggctttgaacattttctcccattttacaaaagcgtttactttctgggcacaaggtccccatgttgggaagagagtggaaagagctgtgcatcattccaggccctgcatattgtgcatggatccctgcctgcctgcaggtgcctgtgcttcagtaaggagaacctgggtaaatcaatcaggactcctttaaactctaggaagtcaagaaattctcctagttggtctctgtgtccctgaagaaactcaacaagaaaagaatacgggctgtgtagccagtctaatctgacttccaatcctttcccaaccactgaccagctagataatttccctaacaactctgagcctcagtttcctcctttacaaaacggcaatgccactatctccctatgtgtttgtgataatcaagtaacaaacaatacttggacagtgcctagaagagtggttggccattgtattcatccgttttcacactgctataaataccctaggctgggaaatttataagaaaagaggtttaaattcactcatagttccacatggctggggaggccacaggaaacttacaatcatggtggaaggtgatggagaagcaaggacgttcttcacatggaggcaggagagagtgtgagcaagagcagggaaaactgccttataaaaccatcagatctcaagggaactcacccactatcatgagaatagcataggggaaactgcccctgtgatccaatcacgttccatcaagtctttccctaaacacctggggattacaatttaagatgagatttgggtgaggacacaaagcctaaccatatcagcagtgaataaggactggtgttctccctttgaatgaaggtatctaaactatgtagattaatcaccagcttaagctatttgctgctacaaaaaactgcaccatgaacagccatgtccacgatgtagcattaattcaaaatggtgcatgtggggaaggtttagtggaaaggctctcccatttgcttatgatggatgtttataggatacagaaaaaaatgcaggactccaggcaatagaaatatttgaataacagcacagccggaacatttgtagcaggtcaatagactgctcctctctccagtaaattccccatcttgagcttctataatattggcatctttgttatgaagcaacttctgatctatttctcttctggaggtatagtgaatgcatttgaaggagaatggtgctttattacagaccaagggccttgtgtttatgatttataatattgtggtgtttgcctgcctaatatcgcctaaagaagtgacaaatcatgcaaaagaaattaacttgccctgactccgggtctgtttgtttagccaggactcttcagattgcaagcgacaggcaaattaaaatagctaaggaaaaagagaattgtaagggcatggaggaatctcatgcaagaatggaatgaccaaaccaaaaaagggcaggaatgcaggtggggctcaggaactataaaaccacagactcagacatactggcattcttttccatttcttgtagcaattgtctgtttctttctttttttaaaaaaaaatctctctcattacaaatggtctttggctatacagaagaaaaaaaagtgtctcttctgatctcagtagcttctgagttttctatttatgatgtcagtcctcagagggatattgagtttactcccttgatgcttagcccagaagtcctgatggagggacttgttggcttagcttgggtcaggtgcccattcttgggccagtcagctgtttccagtgcagcgtggtgacccattctgggtcagatacctactcatggaccaattgacattggctagagatgtagactacttgagaaaatggtccctcaaaagaaaaccaaacagatttgcaggtggaggaggaatttccagaaaaagagccaggttggagagacaaaacaatgggtgaatgctacacctctctcctgggggtggtcacaggaggactctctggtcttgaattttactcacttattcttctcctccttattcattcattcattcaaatacttactgaagtacttcctgccgttttctgagtttagtgtgaatcaaagttctcccctcctactgctgacacatttcttttttctttttctttttctttttttttgagatggagttttgcttttgttgcccaggctggagcgcaatggcgcaagctcggctcactgcaacctccacctcctgggttcaagcgattctcctgcctcagcctcctgagtagctggaattataggcacatgccaccatgcctggttaattttttgtatttttagtagaaacgcagtttcaccatgttagccaggctggtcttgaactactgacctcaggtaatccacccacctcagcctcccaaagtgttgggattacaggtgtgagccaccgtgcctggccgctgacacatctctaaagcacagacacatccactcatagtcttccatcaacgccttggccggagaggtgctcagtcccacttaatagtgggcaggagcttgcagaccacttcacactaatgattcctcctgctcagagatctattctccttgaaatattcagcaatgcacagacaaattgcagacagatcatcccaatctctcaatagtgacacacatacacacatgcacatatatgtgcaattgcacgtgcgtgcacacacacacatacagaggccagaatctctactagatattgagaaaacacttgcttttctcctgcagaataaaacatttagctgaccaaggtcacttttgtattgtattgacgggcctgcaaatggagacgtacggtattaggaaacctcaaatctggtataaatttatgggtcttccttgaacagagttatctcttctttgtccttgagcttttttcatttgaaaagtgaagagcctgaatatgagctagatcctcgcaaccagttttggaagggaaacaccaggtcctaaattgtcaaaactgaggccttatcgaggactctttctctgacattccaggttgtatctaatgaccaaattcttttcttttctgtagtagttccgggtcgtaagcatctttgcttacaggtaagctcccagttaccctgtaacatctagaaagcagacaccagggcttattcttcatattacagatgcccagcacagaacctggtatataacagacacttggtaaatgtttgttaaataaatggactgatgaaagacacattgtgtgggccaacctcacttgtccacggagggatcctcctctcagcaaatagtggctacaatgactttcgcattgtgagtctgaagaacagagagctcaggctgtcaggtcccacaaaggccaccagaattcacatctcctttgacgttctccagagctgggtcacagagtctcctggtccaccaaggatagcagaagctcaagaacagcacactcaacccagtaatacagagagtagcgcaggctcttcacaggcatttaaaaaaatcttggctgggcgtggtggctcacgcctataatcccagcactttgggaagccgaggcgagaggatcacgaggtcaggagatcgagaccccagtgaaaccccgtctctattaaaaatacaaaacaattagccgggtgcggtggcgggcgcctgtagtcccagctactcgggaggctgaggcaggagaatggcgcgaacccgggaggtggagcttgctgtgagccgagatcacgccactgcactccagcctgggcgacagagcaagactctgtctcaaaacaaaacaaaaaaatcttaacagttaccagctactgagcccttatggtgcaccaggcaccatctaagagctttggaaacattttctaaactagtagttctcaatcagggctgattttgccccctaggaaatatttgacaatgtctagacactattttgattgtcatcctggaaggggtttgctgctggtatctaggtggggagggtagaggccaaggattccagtaaacatcccataatacacaggacagcccccaacaacaaataatggtccagccccaaatgtcaaaagtgccaaggttgagaaatctaagataatcccttccacaaccctattcttactataatgtttaccttagtagaattcaggctcttctcaacctcctcacctggtggtctttcattagctttacaaagatgatttattttgggggaaagggctattatcattttaactatagactcaatgtctcccaagcttagcttggtccaagcccaggaattattaaaggcagttgggaggttaaaggcaacatgaaggttggttaggtcagatctctttcattgccataactttctcaccattataatttttgcaaaggcagtttcaactccacagcacagaaacacctttatcaggacccttgcaaaccttgcccctctacctatcacttcatccagttgttcatttgtatcctttataataagacagtaattataagtatggtactttctgagttctgccagttattctagtgtgggggccgtaagttcttggttccctaaaggttcactgaaaaatcattttatgcaggagatgagagaggagaaatgggtcatgaaacgtgtcagcagtaggaggggaagtacatttcctgattttccaggagcagaaactgaggaatatggaatttgcccaagtagcagagctggaatttgaaccctcagtctttcgggtctaacccctaggcgttcaccctctattctatcactcctggcaggtcttgcctataaggttgaactaaatggagaagttcatggtaacaatcctaaacctacttaatatgctgggacttgacaatttccagttgcctccacgtcagattttacctagtttcatgtgagaaactaaagatgttacttgggccagagctggaagtatcttatattgaatccagtttgccctattgaaacataataacttttaaagtaatctagtctcttcattaccgtgttccatccagttgtcgaaatctcttttgagttggtagttaaaaggcccagctacacattcgtaacatcattgttgctggctaaaatgcttagcaacaacacaaacatcactcagaagcaaattatcagatgtaccgacaagatgctcctcaatttaatagcgtggtaaatgatggctgggagatgttctttgaagctgtgaaggcaaatgtgaaagctaattcaattctcaaatgaataaaagtgagaaagtgttcttataaacctgatattaccagagatagggcttgagcatcctgctgccttgtgtgggagaagagagaggagtgggaatttattttatttctgatagtaaagagctgggctgtgcgaccacacgtttgaccttggatcccgggctgggaacttttgcaagcgtgagggctcctttccaactgagctaacaggcatgctgactaaatcgctggttccccttgtagctgcttgagggagtgaggggtctctaaagagaccttcagggctttggggaaatctgatctctattagattttgggaacacagaagataattttctgagaggagaggggatctcatatcacctgggtcagtggctttccaatcgctaatagggccctaggtcttcacaaaggtaactcagaggaaggagaaggaaggcttgaaagggattcacggcctgaaatttgctatcatttattatatatatcaggtttaggggtaagatattattaacattaatattaagatataacaaaggcttctactgctaaaaatcatgaatgccactaatctactcacttagacgagaaaagctgggctccatggagatgtccccaaggccacacaaccagctaagggtcacaacccaataccaaccgggtgcccaagaattcatttcatttctgacactaattacctgaaattaatgtccaacttcacacgttagggggctcagcaccacaaacctgcctgcacttcagatgctgccgcaagccccaggggccatctacacttctgcttggccaatgcggccataaatttggggattcccatgaccccctttcaggttcacaatttgctactgaagcaaattaaaatattttaccctgaaatatatttctctgacatattttgaaatggctttctcagagctagcagattgaggtgggggtaaatttgcatctgtagagaatctccattaatgtagccaggtcttttctatacctttccaagatgtaggagagactgagtctgacacctttaaaagactagaaaggctgatcacaaggtcaggagtttgagaccaccctggccaacatggtgaaaccctgtctctactaaaaacaaacaaacaaacaaaacaaacccccaaaaattagtcaggcatggtggcacatgcctgtaatcccagctactcaggaggctgaagcaggagaatcgcctgaacccaggaggcagaggttgcagtgagcctagatcacgccactgcactccagcctgggaaacagagcaagactctgtcttaaggaaaaaaaatgtcttaaaagagctgggcatggtggctgacacctgtaatcctaatactttgggaggctgaggtgggaggataactggaggccaggagtacaagaccagcctgaaaaacacagtaagactctgtctcaaaaaaaaaaaaaagagagagagagagagagagagaaagaaagaaaaggaaaaataaaaaactttaacttgaaaaaaaagtcaaaaaagaaatttttactatctattctcttggagggaggcctcctccacataacaaggccacctttgctagccaagcctcttcctctcttcctcccgtaaacctgtcttgccactaagcctgtttttggccatgctctaagtccacactctttctgtaatctcaagcttctgtaacttattgttgggttaggtcttcattctgaaggctcctgtgtatacacattaagcacatctgtatgccttttctcctgttaatcaatctgtctcatgtcagtgatttttcagtgaacctttaggggccaagagcttatggtccccacactagaatagctggtagaactcagaacgtgctatacttacaattgctcttttattatcaagaatacaaaccgggtgaagtaatatatagggtggcaaggtttggaaggctcctgataaaggtgtttctgtgctgtggagttgaaactgcctttgcaaaaattataatggtgagaaaattatgacagtaaaagagatctgacctaatcaaccttcatgttgcctttaacctcgcaactgcctttaataattcctgggcttggatcaagctaagtttgggagacattgagtctatagttaaaatgataatagcgctttccccaaaataaatcatctttgtaaagctaatgaaagatgaccaagtgaggaggttgagaagagcctgaattctgctgagatatagacataaatgattaccagccattattctggaggtcatacgattttcaattccctagttactcctgcagataagatcactattgttgaccctaagattggccttttgagatgtcttttcaggtttttgcatttctgataaccaaggactctaccagacctgccaaccagtcctgtggcctctacccagtaaccaactcagcacaagaagaccgctttgactatgtatgattttatccctgacccaaccaatcagcactcctcacttcctggccccgttcctgccagaactatccttgaaaaatcccagtctctgaattttcagggagcttgatttgtaataactccatccccctgggggatgaccggcctcatgttagctaaatgctttatttattgtgatgctgcggtctcagtgaattgggtttgcctgtgcagtgggcaggaagaacccatcgagaggttagagagtgacgatgcggccaggcatggtggctggcgcctgtaatcccagcactttgggaggccaaagtgggcggatcacttgaggtcgggagtttgagaccagcctggccaaagtggtgaaaccccgtctctactaaaaacagaaaaagttaacttggcatggtggtaattccacctgtaattggaattggcacctgtaattctagctacttgggaggctgaggcaggagaattgcttgaacctgggaggtggaggttgaagtgagccaacattgtgccactatactccagtgtggatgacagaggaagactctgtctcaaaaaaaaaaaaaaaaagagtcagaacacacctccctgccagcacatcagtacacttaccaaccagaaagctctcagagcctcattgcccagagtttttgttgagctttcattatataggcatgattgattcaaccatgggccacatgactgaactcaatcatctccacctccccacccctagccacaggttggggcggaaaattccaatcctctaatcatgcacttagtctttctggcatggccaacttctccttcaaaactaattagggtccaccatgagtcacctctttaggataaactcaggtttagtaaaaagagactcattttgaataacaaaatatactcctaacacgtaagaaattcctaaggcatttgaaggagctctgtgtcaggaaccagggacaaatatcagatttaaaaaaaaaaaatcataccataaaggcagaggctgacactatatatagcgcttgtttttttctgtcaccccagcaatccgactaggtgttttctgagcaatgaaagagcagaatatattggtcagagcaggaggtacctagtgattggctaatttacagactaggaaaatgtgattcagaaatgatgggagggccccagctacgtggtgatcaacctggtctaaaagctgggtgtctaaccctgaatggcaagactctgtagggccccctgcttgtttcctatggcttctgtaacacattgtaacaaacttactggcttataacaacacaaatgtattagcttagagaagtgcaggtcagaggtctaaaatgggtctgtgaggctgcgttccccctgaggattctgggggggattctagtcccttgcccattcccatttccagaggctgccaccatcttttttctcacgacgccctttctccatcttcaaagccagcaacacaggatcttcagatcattccctttccccctctccttctgttgttacactgccttctgtctaactgacttttcccgcatccctctcttaagaagtctatgactgtaatcccagcacttcgggaggccgaggtgggtggatcgcttgaggtcaggagttcgagaccagtctggccaacatggcaaaaccctgtctctactaaagatacaaaaaattagccaggtgtggtggcatgcacctgtaatcccagctactcggaaggctgaggcaggagaatcgcttgaacccaggaggcggaggttgcactgagccaagatcatgtcattgcactccagcctgggcaagaagagtgaaactcaatctcaaaaagaaaaaaaaaaaaaagcagcctgtgattacatcaggcacacagggtaatccaggataatctccccatctggggattcttaactttatcacatctgcaaagtctcgtttggcttttaaagtaacatattcacaggttctgggcattaggacataggcatctctgggagggccttgttcagcacaccacagttgtatattttcaccctttcaggcatgaatttgctaggtttcagctcctgcttttgttccttcacaaatccctgatgactactattgaggaggaagggactctgtctctgtctcctttctccaacttgtttttttattttattttattttattttattttattttatttttttaacagagccccttcctacttttgctggcaaggaatgaggtgctgccctttgaccatacaaggtcctacttaccagaggtgcgagcagtacctttagcactgatatacatctgtgggcacttccttatcgtcctacccgccttgtgtctgccagggctgtgttgctttcctggtcctccttcatttgtggggaggaggtttataggatgtttggaaatattgttccatcatctttgttctccaactcagctcttaccagaggcccctgtaaaacaaatctttacttttcagctagataagttggtgctttatttcctacttggacaatatctaatcattcagaagagataattgtgtacccaagcctcatttacaaacccatttctcccctctcatctcccactgctttgctgtgtgagctgtagggatttactgtcctctcctttttttcaaagtaaaagatagagtggctccagtgagaaatatctttacccccatgatctgcataggtcagtggttttcaatccccaagggcttcccccacctccccagggatatttggctatgcttgaaggtgttttggtggtggcaacttgggaaggggattgatgctggcttctagcaggtagagaccagagatacagctaaacattcatcttacaatgcacagaccaccgccctgactacaaaagagaattatctggtccaaatcaacactaacgcttctgttaagaaatcctgacttagggccaaagagcaggaaaaaacattgcaataagtttagtctctttccctaccaatttacttgatcctctccataggagatttgggactattattgcagcacattaataaacaggcagggtctgtctttgtgcttccaaagcttcaaacacaagggcttcctctggtcttgtctgccctcgcacacagcaagtcttccttctcccatcctattgcctacccatgcagcaaaaataataagcaggacgctcctgctgaggacaggaggagtgaggggagattgcctttcactgattactgaagcctgaacttaaagggcctgaaagtgagggctccaaaccagttctgaatgctttgctgtgatttgtactttggtgtattggtaacttgagtgcgaagcataaacaaggatcagtactcagggccatttcttgatttttataatgtcttccaggccatggggagggcaaggctctagttgcagccatgtaaagctttaccttaagtagagctttaccttaagtaaggctgtaagccacaggggcttggagaaatctacagtagatagcagtgaacaagacttcctgggactctatctcagcttgtactgagtgactgctatatgggcaagtcaggtcctcaagccaaaaaacagatggccaaagggaatttttatgctggattggagcagaaaaatcctgcttcttcctatgacagaaaaaagagagagagagagaaaaaaggccactgcttcttaagaggtaagcctcatatgtagttataaaggataattcttcctttaaatgcaaagaaaaataattttaaaattgcttcattgatcgaaaaataactgagtacaaacaagtattcacaccacaaaaggcaaaagccttttttatcttaacgagaatattatcttgttacagttaatagttattggattacccattatgtcccaggcactatttaagggcactgcaaatatattatctaatttaatcttcaccctaactctcagtccaaggttattacatcaattttatagataaggaaatcgagagagagagaggtaaaatcacttgcccaagatcacacagctggtaaagtggcagagaaagaattttgaaccgagatttggctgatcaaatgatcccttgtaaaccctgtcgtattttttttcagatgaatcctccatatttgcattctcacactttattataagagtgacctaaattccactccagtttattttttttgtaatgtcttttatcggttttggtatcagaaaaatgccggactcatacaagaaattgggaaatgtgttttccttttcaaatttctggaagagtttgtgcagaaatgctgttaattattattattattattattattattattattattattattatttttgttgagacggagtcttgctctgttgcccaggctggagtgcagtgccgccatctcgggtcactacaatctccacctcctgggttcacacctttctcctgcctcagcctccccagtagctgggattacaggtgtccaccaccatgcccggctaattttttttatttttagtagagatggggtttcactgttagccaggatggtctcgatctcctgacctcgtgatccgcccaccttggcctcccaaagtgctggggttacaggcgtgagccaccatgcccggcctgctgttaattatttttaaaatgtgtagaagaattcaccagtgaagccatctgagccaaaaattttctttgtggaaagtttttaagctacgattcaattttctttaatggctatagcactattccggtgatttatttcacttaagtgaggtttcattgttacatctttcaagagatttatcaatttcagttgtcagtgaatttatagacacaaagtttataatattcacccaagtatccttttaaatatctgtagaatccgtaatgagattacctgtctcatttttgatattggtatttgtgtcttccttctttttttctgatcagtagggctagatgtttatcaattgtttgatctcaaagaatcagctatttgctttttttctatttcatttggttctgctctgatatttattatatctattcttttgcttattttgaattagtatgctttcagtttaccttgcttttcactttctatttttctaagatggaaactgaggtcattgttttgatacatttataattttctaaggtaggcatttagtactacaaatgtctccctaagtactgctttaatgacaatgtacaccttttgttgtattttcatgtacattcacttaaaggtatcattttcccttttgatttcttctttgacctatgggttatttagaatgacgcaattaagtttccaaatatttgtttttttccagggatctttcagtcattgatttctcatttaattccattatagtcagaaaacagtttggatgacttgaatccttttaactatattggtgcttgtattttggcttttgtattctggcccaggatatagtctatactgataaatgttctgtggagacattcaaaacacactgaaaagaatgtatattccactgctgtggaagggagtgttttataaatgttaattcagtgaagatggttaatagtattactgaagtcttctatatccttgctgattttccattgacttttctgtccattactgagacaagagtttgaaatttctgactataattgtaaaatactttttgcatttctattggtttttgcttcatgcattttcaagctccaagtaactgatccccttattaaggaaccttctttattccttgctgtgaaatctactttctctgatattaatataactactcctgccttttataaaaagtatatgcatggcatatctatttctatccttttatgtttaacctatttgtgtatttacatctaaagggcacttcttgcaggcagcagatggttaggtcttgtttttgaaaatatccacattgacattgctgccttttaataaggatgatcagaccatttaatatgattattaatgtagtttatgtctcatcttgctatttgtttttcattagacctatttgttatttgtttctctttccttctattccttttttaattttttaaattaagttctggggtatatatgcagcatgcaggtttgttacatagatatacacatgccattgtggtttgctgcacccaacaacctgtcatctatgttaggtatttctcctaatgctatctctcccctaaccccccacccaccaacaggccccagtgtgtgatgttcccctccctgtgtccatgtgttctcattgttcaattcccacttaggagtgagaacatgtggtgtttggttttctgttcctgtgttagtttgctgagaatgataatttccagcttcatccatgtccctgcaaaggacatgaactcatccttttttatagttgcatagttttccatggtatgtatgtgccacattttctttatccagtctatcattgatggacatttgggttggtcccaagtctttgctattgtgaatagtgtcacaataaacatacgtgtgcacgtgtctttatagtggaatgatttataatcctttgggtatatacccagtaatgggattgctgggtcaaatggcatttctggttctagatccttgaggaatagccacactgtcttccacaatggttgaactaatttacactcccaccaactgtgtaaaagcgttcctatttcttcacatcctctccagcatctgttgtttcctgaccttttaatgatcaccattctaactggtgtgtgatggtatctcactgtggttttgatttgcatttctctaatgaccagtgatgatgagctttttttcatatgtttgttggctgcataaatgtcttcttttgagaagtgtctatttatatccttcggccactttttggtggggttgtttttttttttttttttttttgtaaatttgtttaagttccttgtagattctggatattagccctttgtcagatggatagattgcaaaaattttctcccattctgttggttgcctgttcactctggtgatagtttcttttgctgtgtagaagctccttaattagatcccatttgtcaattttggcttttgttgccattgtttttggtgtttcagtcacaaagtctttgcccatgcctatgtcctgaatggcattgcctaggttttcttctagggtttttacgattttaggtcttacgtttaagtctttaatccatcttgagttaatttttgtataaggtgtaaagaaggggtccagtttcagttttctgcatatggtctgccagttttcccaacaccatttattaaatagggaatcctttctccattgcttgtttttgtcaggtttgtcaaagatcagatgttcaacatacgtgcaaatcaataaacataatccatcacatacacagaaccaatgacaaaaaccacatgattatctcaatagatgcagaaaaggccttcgacaaaattcaacagctcttcatgctaaaaactctcaataaactaggtatggatggaatgtatctcaaaataataagtgctatttatgacaaacccacagccaatatcatactgaatgggcaaaacctggaagcattccctttgaaaaccagaacaagacaaggatgacctctctcaccactcctattcaacatagtattagaagttctggccagggcaatcaggcaagagaaagaaataaagggtattcaataggaagagaggaagtctaattgtctctgtttgcagatgacatgattgtatgtttagaaaaccccatcgtctcagtccaaaatctccttaagctgataagcaacttcagcaaagtcacaggatacaaaatcaatgtgcaaaaatcacaagcattcctatacaccaataatagacaaacagagccaaatcataagtgaactctgactcacaattgctataaagagaataaaatacagagccaaatcataaatgaactccgattcacaattgttataaagggaataaaatacctaggactacaactcccaagagatgtgaaggacctcttcaaggagaactacaaaccactgctcaaagaaataagagaggacacaaacaaatggaaacacattccatgctcatggataggaagaatcaatatcatgaaaatggccatactgcccaaagcaatttatagattcaatgctatcctcaagataccattgactttcttcacagaattaggaaaaaactactttaaattttatacagaaccaaaaaagagcccatatagccaagacaatcctaagcaaaaagaacaaagctggaggcatcatgctacctgacttcaaaccatattacaaggcaacagtaaccaatacagcatggtactggtaccaaaacagatatatagaccaatggaacagaacagaggcctcagaaataatgccacacatctacaaccttattccttaagagtattttacaacttcattttttataaaataagttttattgagatataactcacatactatcaaattcagttttttaagtgtacaattcagtgggttttattaaattcagacttgctcaacatcactactatctaatttcaaggcatttttctcatcccccaaagaaatcccatacccattatgcagttattcttcttttccccttatcccctctggcaaccactattctacattttctctctttggatttgcctattctggatattttacattaatggaatcataaaatatgtgagtttttgtgacagtattcttttacttagcataatgttttcaacgttcatctgtggtatagcatgtatcagtgcttcatgcctttcctttttgtattccttttattttttatttgcattccttaatattcctttttgtatagataggtcacattttacttttttaattcataagttgatgaacatttaggttgtttcaattttttaagtagtgtgaataatgttgctatacacattaatgtacacatttttgtgtggacatatgttttcagatctcttggatatgtacctaggagtagaaatgctgtcatataaagccacgtttaacagcttgagaaattatcaaagtgctttccaaagttcctgcaccgttttacaattccatcagtaattaaggttctaatttctctacattctcaccaacatttgttattgtctgtcttttaaaaaacagtcatcataacaggtgtgaagtaatattccattatagcttagttttgagtttccttaatgattaatgatattgaacaacttcttgtgtgcttattggccatttatcttttttgaagaaatgcctactcaaatcctttctccattcttgaattgagttgctttaattgttgagtcaaaagatttctttttattatacattctggatacaaagtccttatctgatacagaatttgtaaacattatctcccattctgtggtttgccttttacccatttcgatggtcttttttaaagcacgaaagttttcagctttgatgaagttcaatttatctattctgtcactcatcttttttttttttttggtgtcatatctaagaaggctttgcctaccacatgttacaaagatatacgcctatatacttcctaggagttttatattaactcccgtatttaggttgataacagatcttgagttaatttttgcatatggtatgcaaaatttattcttttacctgtgagtatcaaattgtccaacatcattcgttgaaaaggctgttcttttcccattaaattattttggcacctttatcaaaaagtaagttgactataaacgtaagagtttattttgaggctgggtgcagtggctcatgcctgtaatcccagcacttcggaaggccgaggtgggcagatcacaaggtcaggagatcgagatcatcctggctaacactgtgaaaccgcgtctttactaaaaatacaaaaaaaaaaaaaaaaaaaaaaaaaaagccaggcatggtggcaggcacctgtagtcctagctactcaggaggctgaggcaggagaaaggtgtgaacccgggaggcagagcttgcagtgagctgagatctacactgcagcctggggtgacagagcgagacttcatctaaaaaaaaaaaagagtttattttgggactgtcaattccattccattgatctgtatgtttagccttatgccagtaccgcattgtcttgattactacagctctgaagcaagttttgaagttaagaagtgttaagtccaactttcctctttcaagattgttttggttattctgggccatataaaatttctaattatcttgtcaatttctgaaaaaaaaatcccactggtatagtgataatgaaatgggagagttccctgacccccgccccatctcaggacctgtgacaggggtgtgactcgtcttttcagccaccacctctgttcaaaccccttatgggagggggagtatgcagacaggcaggtgcaggagctggggtgagcacttctgggctttggccccatagtagcatctaggagtgggtgcctacaactcccaaagcccaagtgggcatgtgttatagtgcactcttttagctttgccatccgtggatggtgtaggtgttaaacagctcagtggaccctctgccttttcacgagggcagagggccagtgcgacagttttctgtatcccgagctcttgtccagcatccaggaaaaatcaggtcacacaacgactcgaaggatggtgaatgcaggggttttattgagtgatgggggtggctctcagtgggatggatggggagctggaaaggggatggagaagatgatcttcccctgcacattggctgtccagcagccgatctcctctctgaccatccccagctgaactcctcttgatgttcagacattccttttcttctctccttctcttctgttcttctgctcttctgttcatttgctcatctgtgcttggagcctggggtttggggtttatgcgggtatgggatagaggggtatggtgggccaagaggcaacatttgggtacaaaaataagaatgcctgttcccatttagggccacaggtttccaggcttgagggtggggcctttgccggggaactgtcctcttctacctctgtctcctgtctgtatcagtgagaattgaatgaaatctttagatcattttggagagtgtggtaggtagaattatgacccccaaaagtatatgtcctaaactctgtaaactgtgaatgtgttatcttacatggcaaaagcaacattgtagatgtgattgagaatgttcatcatgatgggctcaatgtaatcacaagtgtcttttataagagggagaaagaacggtagatttagagaaggagatgtaatgaggaagtagatatcagagtgatatagtcccaaactataccacctggtcccaggatttaatttgtaggattttttttttataagcctcagcatcccaagtatctgggattataggctcctgccaccatacctggttcatttttgtattttaaaaaaaggaatctgtcgattttacatagattatctaatctgttgttatacatgtgttcacaatatttgaattctttttatttctgtaaactcagtagtaatgttccctgtttcattcctgatttcagcaatttgaggctaccccctttttcctcggtcagtcaaagttaaggcttgccaatttttttaatctttccaaaaatcaatttttgatttattgactttctctactgtttttgttatgctctgtgttatttatttatactctcatctttgctatttttctccttctgcttttttaggtttagtttgctctttgtcaaatgaatgagccacagatggcctctgcatattagcccctaggttgtttgtttcttcactgcaggctgagacctgttagctcaaaacccctccagcatcaaactcaaatttttacgtagccgtttgttttaaaaatagcccaaacaaatagctttgtagctatttagggtctgtttgctttgcatgccctatgaaatctcattttgcattggtattggctaatttatgtcctcccaaaattcatatatttaagtcctaacccctaatacctcagaatgtaagtgtatttggagatcacacctttaaagtggtgattaaggtaaaataaagtcatagggtaaactctactgtaatccaatatgtccgtcatccttataagaaaagaagactaagatacagacagaacaggctaaggaatgactatgtgaggacatggtgagaaggcagccatttgcccagcaaagagtgaggcctcagaagaaaccaaacttgctgacatcttgatcttggacttctagcttcgagaacctctgggaaatacatttatgtgtttcgtttgtttgttttgttttgttttgttttgttttgttttgtttgagacggagtctcgctgtgttgtcccggctggagtgcagtggcgccatctcggctcactgcaagctccgcctcccgggttcacgccattcgcctaagcctccagagtagctgggattacaggcgcccaccaccacgcccggctaatttttcgtatttttagtagagatggggtttcaccgtgttagccaggatagtctcgctctcctgacctcgtgatccgcccgcctcggcctcccagcgtgctgggattacaggcgtgagccaccgcgaccggcccatttctgttttttaagctgttcagtctgtggtgttttctgatggcagccttagcaaattaatacccacatctgctagcaatggataagataaagccttgtagttataagactccaagctgctactgctcttgggagctttcagatgtaaagacggcctgctataatactgaggatgttacctacatatgtaaactctttctccccaacccccttcttcctagaagtaaccttgcccccatttcctttagaatggtggcctcctaggattaaacctcgggaatgtctcatgttgccagcaacttcctctcctaggcaattctgtcaaagcaccaccttataaagcctgtgtgttactgtcatggacagccctgaaactccttgaattctaccccgacactcctttttactctagctttttaaggtggaaggttaggcttttaattggacatcctcttctcctcttgaacaacaccctttttttcaagaatacctgttcataccatatattcctctctgaacactgatttaggtttatcccataagttttggcacattgtggttttattttcactcatcttaacgtattttctaatctcctttgtgatttcttctttggttgttttaggagtatattttaaaattccaagtattataaaatttctaaatttctccctgttaatgatttccaactgcattctatggtagtcagaaaacattttgtattatttcaatcattttaaatttattgagacttgttttgttgcctaacgtatggtctatcttggagaatgtttcatctgcacttaaggaaaatgtgcattctgttgctgtggggtggaacattctatactatctactagtattgttcaagtcttctgttttcttattgattgtttgtgtaattgccctgtccattattaaaagtgggtattgaattcttcaactattattgctgaactgtcaatttctcttttcagttctattagttttaaaatatatttctggggtctctgttgttaggtatatatgtattgcaacttttatatcttcttgatggatagacccatttatcattataaaatatttttgtctctagtaacaattttttgtcttaagtctattttgtctaatattagcatcatcattccagctatcttttgatcacatttgcaaagcatatctttttccattcttttattttcaacataccatgtctttgaattcaagtatgtatcttattctcagcatatagttggataatgctctttaaaaaatctattcttccaatctctgctttttaatattaatatttccttttaatgtaattattgctatagtaagatttatgcctaccattctgatatttgttttttatgtgtcttatgtcttttgtttataaatttcctccattactgtctcatatgaaatcgttattttcttgcacgatattttatttcccttgtcatttctttacacaccccccaccaccgcacacacacaaacacaaacacataaacatatacctacatgcattttagttattttcttagtggctgtcttggagattataatcaatatcttaatttataataatatagtttagattaacctcaatgtattataatagcacataaaaattttgctcctatatagtttggttcactttctttgctgtgttatcatactaattacatctttatgctttctatacctgttaatacagatttataattattgctatataaagttgtaaatcagatatgagaaaataaggctgacaaacaaaaacacatttatattgtcttttatatttacctatgtagttacttttatcagcattctttatttcttcatgtggatttgagttactgcttaatgtgtttaatttcaacccgaaagattccctttagtatttcttgtaggacagatctgctagtgacaaagtctatcagtttttgtacatcttggaatgtcttcatttctccttcatttttaaaggacagttttgctggatgtaaaagtcttggttgacattcttttttgtattttcaaatgtcacctcactgccttctggactacatggtttcgggtgagaaataagctgttaatctaattgagaatcccttgtatgtgatgagtcacttctctcttgttgctttcaagattctctttgtttttgtcttttaacagtttgataatgttttatgtgtgtatctctttgtgtttatcctagctggagttcaccaaatctccaggacgtggaaggatgtaaatgtatgtttttcatacaatgtgtgaattaagaacatgatacatttaaacgttccttctgcatctctctctctctctccttctgggttatcagtatgtgcatgttggtatatttgatggtgtcccacaggtttctaagtcttttttcttctttttttttcattcctttttctttctgttcctcagactggatagtcccatttaaactattaatactattactgtatttgagtttactgactattccttctgtctgctcaaatgtgctgttgactcctttttgaatatttcacttcagttacagttactttcagctcaagaattttaattctttatattgatctttctttattgatattctctctgtagtgagatactgctttcatattttcctttatttctttagacatggttttcttcagttctttgaacatactcaagatagcttatttacagtgtttgccttgtaggcccaacatccgggcttcctcatggacaacttttattgactattttgtcattgcatatattgtgtctggttctgttcttgttggttttagatgttttcaaactaaattgtattaatgttattttatcttgtttgaatgaagaattgatgatgttcaaaataaattttcaagatagttcataagacacaactgggctgggcatggtggctcacacttgtaatcccagcactttgggaggctgaggtgggcagatcacttgaggtcaggagtttgagaccagcctggccaacatggtgaaaccctgtctctactaaaaatacaaaaatcagctggacgtgttggcacgtgcctgtagtcccagctacttgggaggctggggcaggagaatcacttgaacctgggaggcggagggtgcagtgagctgagatcatgtcattgcactccagcctgggtgtcgcagtgagactcagcctaaaaaaaaaaaaaaaaaaaaaaagacaactgtctgtgtgctatttgttcagtctctgttagtgcactgcatccaaacaacaacaacaaattagtgagtcatcaacaagaattagcagctatcaacagaggaaaagttgtctttttacagaaggataaggtggaggacacaaaccatgcaagccaagaagctaatctagtaactgtgattcttttctctctccctttctctaagcccacctcaactgatcatctgatcgctgaactgaggcatagttaggccatgggaggggccatgaagatatatgtgaaccttaccaatctgggatatgttttcaaatgatgatgaagagtaaaattctagcctcagcatctcctttggtgaattccaaaaaaagtccattgatctttcagaaaaaagaccttgatctgaataaggaggtggagaatctcagaaatctccctggagaactgggaaatatgtaaggaataaagtagacagggtctcaatgggagtaggtaggggcaagtagaagaggaagaaagtaatgaataatctcagctccttaaactcttttctcattgctgattcagccctttctttcctattctctctttccatcttctgatttgtttaaccattcaacaaaattacactggaaatggaggatgtggaggtaaacaaaaccaactcactaaatagcaacaacagcaacaaaccaatccctgccccagtagagcttacagaccttaattaaataaactttcctatttaaaaagtgctacaggggcatacaagagcttataacaaacagatggcctagatttactatatcggggggaggaggttgacaacagagtgacttgctcagagagcagaaatgtggaagaaaaaggagggattaattcaatgaagcaggtgaggtcaacacttcatgcagaggtacccaccacgcataggccaggaagcaagaaactgatttcagtcctgactccagattttcatcccagagcatgttgggggattggaggaagagatctttgtttgtcaccatgatcttggaggtcttgacatgatgctggagtcatggggggcttgcttgcttgcttttggaagccaaatgtctgtctctctatcctcttctgactctcaccccaacccagatcagtttctgccacgcagtgggtccaaccagtgcctggattcagttcgctggcccctagcatgtgaattgactgacattcttgagcacattattttttctctaattaggcagtatacctgtactgccagtggcttctcctgagcctatggagccacaggaggtcacattaacagtcttggtataataagtcattgccatgcaagctgaaggcaattaatcctaaaatttggaactgttcgagattaattccactaaactatattgtgaaaccagggcaaaaaaaatatatactaccatttatacctggtgctttttgtttcatgacctcatttacttcttaaaaccaacatttcaattaggcagtattgctattttccttttcaaatgaagaaactatgcccagagaggtctgtggaactcacacagcatcagtgctagagttggcatcctagtccatgactaagttctttctgcaatcctatgtgagttatgcttctggtactctgcactgtatttcacactcaaaacttaactattattatctcattatcaccagagaattgatgcagcactctgacagctatgatttcttttcttttttttcttttattttgtggtctctatgtaaataaaatcttttcaccctaatggctgtcctgacactgccaaatctctgatccacggggagacacagggagtctctgtccagagctatcttcctcccagaagagctaacgaggaaaaaaagtaacagaaggtaacttgctgatcctaattactttgcccgttgtacatgtctcagatcaaataccattttgtcctctttttcccctttagggagaattaattaagctctaattacatcgacagaaaaaatagaagctacaataaaattattttttttttaaaaaagctattaacaaggtctgagcacagagcttgttataacctggggagtgagcctcatttgaattttatggcctttgcttttacatttttttattaaaccttttcttaaaatcctcaatatgtcttctttccatggtataatctttcttgggaatttgcaggtgttaaattagatgcttggggctctcttaccctccctgcattcagtcagagtatggtgtatcccgtgaggcagattaatcatttttttaactgatttataagttcacactcagtttttttttctatctggaataaaatctgacgcacagagcccctctggttcaggcaaattgagccaatgttttccttgttagagaaaaaaattaaaaagcttattccaatcagcacatctcactgcaaaaagggagttcaattctttctccctgtcaaatggaatccagccatgcagaccgggctgtgatgatgtgaagatggaaagaaccttcccactcagagagtgagaggtcctcttaccctacaagacgcacattactgacctgaaggtcagagcttgaaaagtaaactatccgaggaggagatgtgacctaccaccgggtaacgcgatgcagggcagaactccacctcaaagctagaccctggacctgcccagcagttcttctaccaacatagctgggccacctgggtaaggtgtttagaattcagattctcatctcagtcctagatctactgaatcagaacctctatgagtgggatcctggaatttgtatttttcaaagccctcagggagattctgatgactagcaaggcccaggagtcatctgattaaaatagtaagactagctgcaaaacactaattttcagggaaggggaacacactaggtattccaaatagcagagaaggagacatactcccaagaaactggagattttagccaaggtggcttcctaaaggggaatttctctggaatctttttgttggtcttaaaaattgatataattttggattccattctaacggtgacatatatacaaatagatgtatatacacgcatatacagatactcttatacatattcatacatatatatctgtgtgtatatatgtgtatgtacaattgtgtgtatgtgtgtatctgttacattgcctagaacagcccacgctatagtcagaggacacatacagtctttcccaagatttctacaaatccctggtggggttgaacgtgtgagtacttatatcctgatatggtttggctgtgtccccacccaaatctcatcttgaattacagtttccataaaccccacgtgtcacgggagggacctggtgggaggtaattgaatcataggggcagtaactcccatgctgttctcatgatagtgcgttctcatgagatttgatggtttttacaaggggcttttctccctttgctcgacacttcactctcctgtcaccatgtgaagaaggatacgtttgcttccccttctgccaagattataagtttcctgaggccttcccagccatgcagaactatttgtttgttctatttctagatcctttcaccatttcatgggtatcatctctaatttttcatgcacataaagtgagcctgcatttgatttccactaaaatccattctcataaggtattgttttatacagtacactctcataaagagtattttggggagaaatgcatgggtgaggggcagtgatgtgctggatctggctaatacagggccatgagagccagccattaaatttttaggaattttgcaatccagttgttaagcaaaaccatgattaaatattatataaggttgtaattaagttgtacaattaataaaggtagtaagtattagaagctcatcacttactagctgttttactacattttattcttacctatgcccttgaagttatttgtatctactgtatttgtgtagtagaaatacaattaaatgtgttgctattgcccatctctacccaattctgtgtttagtgattatacatgggtaacctgagattggccatagcaagagtatttacatcacagaaattggcaaatgctacaaatctaggcttgatttattgctctgctgattgcctggacctaaaaattaatggataatatgttaataatgtccataagcttaaatgtgtcatgtctatagccactgcattgtcaatagtataaaaactgaagacattttttcagcatttaaaaactttttgctgattcagcaaagaagtcattcacatcattgacaaatgagtgaagttctaatatatgttttctttgtttcccttgtatcttattcattaatatataacattaaccaacattcatgttgaaactacacttgcattcaagatttgtagcctgattttatcaagtgatggttgaattgcaatcttagatcagttatacatataagaattctgcaaaaaccaagaaagtgttctgtaagtatcagctggctatatgacaaagaatactgtaaaatttattattataaactgtttgttacatattctttaggtcagtaaagtttctaagaaacttaagtatgtttccccagagacctagttgttaagcatttaccagtctcccacaagagtttatattacaccaacataaacatattgaatagtaaatgtcctttgatatatatacatgctttcacacctcattggtggtaattgttcttctcatcaggtgcaaaaactaattcccttcatcttctgcaagctgtttagtcatctctttcattggattactagataattgcaggttcccacccaaacctccatgtccttttctcccatcaagagcatgcggatctttcattggtggttacatccctcttccattcccagtcctattgtttgggtagatttaactccattctccagttacaggaattgactctgcaagcttaagccaatcagtgggttccagctctctggccacagtgattggtgcggagttgagcacatgacccaatttgggccaatgagagagaggaaatctcaaaattgtagttgaaaatattaaaagagagctatgagttttctctggacaatgtattataagataggaacaactttatccattttattatcacaggaagagagctaagagctgaagggaaagaaaccaccagaacccaagaatgaggccaaatccatagaacataaacagaatagagaacaacctaggtccatggtaaaatcacttgagctactagatgaagctttacctgaccagatcttcctggggtttaggtacaagtatgaataaatctcctttgtttttaaggcccatttgagttgggttttcaatcacttggaaccaaaaagatccttaacttttatatttgtcttgactcttaagctcaggggccttactttccattccaaggctaatcaagcctttcggtaaaagataggtaatttcttccctaagagagattctcctcaaactaataaagtaaaacatttttaaccccactagacaaaagtagtgtttctaataacttattgccaagcaaaatgaacattctagaactttgcaccatatttgttccatggcttcctacaacttgctagcacaggattacacacacatatatatatatatatactatagggatgtgcatactttagattgagaagtgtggcactgaagcatgaagccaccatttacatttcagggaaaattattttttcaatgatttgcttaaacaagaattcttggttgaatatccatgtgttttatgcggtcacagggtaggatattgagagaactggatgtagaatgcagcagtttgagggaggtgtagtgtgatgatgatgatgctaatagcaaaaactttcatagttcttgctacgtgccaggctgtgttaagtgatctccatgaattaatcctcatttccatacccagtttacaggtgatgaaatggaaatgctagcttaacttcatacaccttggttcctgagtctgtgctctaaccagtaggttgtactgcttctccactgtgtgcttaagacaaagttgggaaaatggaaatgaatttggatccattcataggaactggtgagtccaggtcaggatctgcctttggggctctgagagttgtagagtcacagtattcacaaaagatgcctaactcatgccagcaaagcagacaacagaccaaatacaattcatgcttgaagaggactggagttagaatcagagaggcagccaagagcaccatttccacagagcaagataaggctatcaacagtcaaggatcagacagcaagaagatgtggacatgtcagccaatggagcggaagggctgaagataccagctcagaatggagactaaacaatgagagggcaccaaaggatgatttttttaatgtatcaaataaagaaaagtctgatggttaaaggctatgcacttagatagaggggtactgtactagataatcattgtcatagtaatgctaggtaagaaaccatgccaagactcagtagcatccaaccacaaacattcatttcttgttcacagatttgtgggccagctggggttcagcacatctaggctatgctctgcttgaagcagcaaactgggttcagatccattctacatatctctcatcctcttcggaccagcaggaaagccagggcaggcttatataacagcattgacaaaagcaagtttatactagtgtatttcaaccaaccaaaccatatgagtttggttgaccaaaaccaactcatatggccaacctcaaagacatcggacactgtgtgccatatatgaggatatggcaaggaaggtagatttagtcctgatactatcctaggagaggaagtaattaagactaacaactaaatctactctagtgcattagtccattttgaattgctataaaggaatgtctgagactgggtaatgtatttaatttaattaatttattcatttttgagacagagtcgctctgtcacccaggctggagtgcagtggcacaatctcgtcttactgtaaactccgcctcccaggttcaagtgattctcctgcttcagtctcccaaggagctgagactgcaggtatgcaccaccatacctggctaatttttctacttttagtagagacggggtttcgctgtcatggccaggctggtctcaaactcctgacctcaagtgatctgcccaccccggcctcccaaagtgctgggattacaggcgtgagctactgcatccagcctgagcctgggtaattaataaagacaagaggtttatttgactcacaggtccacagactatacaagtatgacaccagcatctgcttctagtgaggtgacaggaagcttttactcatagtggaagggaagagggagcaggtgggtcacatagcaagggagggagcaagggagaaaggagaagcctccaggctcttaaacaaccagctcccatatgaactaacagggcaagaactcactcattactgcaaggatggcaccaacccattcatgagggatccacccccatgacccaatacctcccatgaggccccacctccaacactggaggtctcatctccacatgaaatttaggggggacacacattcaaaccatatcatacagacccaaaagaaaaacagagtttgttttacagtgatataagggtctaccctaaagaaggaagcaaggtgtgaggcagtgtccttggcattggagaaggagactggggaagtacccatcaaggtgatgaggtatatgagagaatggcagaggagaatagggggaggcggggatgcttttcccaggtcttgatggacatcactagatgggccatggctatttctaaggtagctcagtgggaagaatcactcaagattcaattgaaattgtgttcaggccagttataaactagtaaagatgcaatggtagaggttatagattgagacttaggtttcttccttttctggaaggatcctcagatcgccttactgtggatctaacatagccagcccaagagatgattaaatttgtgttctgttgggctatgtcagggtcaagttttaaaggaagcatgcagtgattcagaaggattgtgtttccttgtcaatttcacctcttgcttcttgaaggagcctttctagtcttttcttggccaccagagaatgcagccatgaacaaagttagatggcccatcatttatgtcaggaagttgtgaatgcagatttgctgagctaattcacccagattatctcagcaaatctgcatgcacaactttctcagttaaatgatctttactacctatgtcgggctgtctgaatctgaaattatacccaatattccttggggctcaggacattatagttagcttttgctggatatcagagctttacatataataaatgtcaacatctgacaccttaaaaaaaaaaaaaaccccaccagatactgttttagagcagtaactctcaaccctgtctggatgttagaatcatcttagaagctgtaatatcacagatgcctggggccctccccagactaattaaatcaggatctcaaggtagaggaagtgcctggacttttttaaatttttgttaagctctccagttgtttctaatatgtagccaggtgtaaaaaccactattttagactctctcatttaatcagcatgatgctgtattggtctggtgacttctcttataaaattcactgtgaaaatataaaatatgttcatgttcattctgtgttcgttgaagaatggaactatttgtgaagatcaacacgtttctttgctctgaaagtttgcaacagtttttagccaacagcaaggtggaggcatattttttaaatcaaaacattaataataaataattatgatgatgaccatgatgatgataaagtgtcaggacacctgggccaactgctgtcagacacaggatgttgtaactttttctcttttcccttcaggaattgtgtgcatttattgataaacatggaggcttttgttttagaatcaaggaataacggggggcagatgtgttgctagataaaatgccagcaggagaaattctttgaccatggatgggaccgcttgatgtctaccttctccttcttagagtgcacatttcttgcatgtgctacaagtgtacaaactaccttgtcttaggggatttttgagctctggatattttcagagctatttcatgggcagatgataaagtataaggtacaactggggagaagcccattctctcttctgatctgagacctctggagcagcactgatcagaaatagccgcccccatttcacagctgagactcagataaagtcagagatttgcccagcatcactcaccaaggagggatggagctgggatttaaacccagatcttccaaacaacaaattctctgctcatttcaagatagaaaaccatggtattttggggaactgggaataaaacaatagagggttctgtggttttttgtttttttttttgtttttttttttttagttaatatctccctgacattagtttctctgggcacttaggagtggctctctgtgttaagaaatctcttcatgttgtttcaaagacatccgcaagccctgtgacttcattctcaagcaacaggccactgctgtggaaaggacatgaaaccagctcatttttgcaacaaagaatggaaaaccttccctgccagaatggttcataccttttagtttttccactggggagtggaaacagtaagggaagaagcagagatgtggggcttcaactccctgtctctaccactgttgcttttccttgggaccagggacttccccgactccccacagttgccttgggaatcatccctccaggaaagaactgacactgcattcattttcctgccaggaagctcttggatggctaggagtttgcaggggatggccaggttggagaatttattttcaaagttgacctcaacttggaaatcctggccctgagctgcggggagtcgtctggtcgtccgcttgcattctgtcctgatttctttctcatgctctgagttggcttggttacagttttacttttcatttttcctccatgtctcccaaatgtagtcttggcacactctcctctattataaacctcattttgccataatcaggggttaattagataggcatcctcagattccactgcaacattctgatcagtgaacctgactggtgccaaggaagtcggtggacatgccagcagggcagaaacacaactctctgctacaaatgcatgtacagtatattatcctaaatttcttagtatgtttgtgaagcgccaagagtagtatgggagatcatattctgaaacaaaaggcaagggttgggagagaaaaaacagctttttgatgacaaagcaaattgttccacattgctgatttacccaagagattattctgcattatctattattggaatggaatgtcaaaatatttcttttcctcaaacatgttagaggttgcaaaactcatttacattgaaaatatctggccatgattcctcagctaaggaaataaccatctccaaagttatctgtggaagtcagggagccaataatgtttggctactgtgacgtttgtttggcttaatgggttccttcctgagaatctgatgtcttttccacctgctcaggctacagtggaattgaaactgacatacttctacccacaggtccctttcttctctgtagattatatgaaaaatgtgcccaattgcaattctctcattatgttcactcacctaacactgagcaaatgtctctttgaggatctgttgtctgccaagtaccccattttctctttcagcctttttcgctgctttttcatcttccagtatccctgaaagtttagagggagaccttattctgtcctgaatgtcccaggtccaccctgatatgcagcctccaggaatcagctctgggtcctattcccctcattctccccacgccacccccatcctccgccatagccccttctatgcaggcccgcattacaatgcagtgagaagaaaaatgacagtcatcgtgcaaaaaaaagaaaaaaaaaaccctaaatttaatgaacatttaactctgtctagggcctcaattgcactgcaaagacacataagtcatgtttcctgttgtctagggtggacaatctaatgaggaagatgcacccatacccagtgtgctatttcaaatcctcggcaacatgtatgtcatcacacccacaaatcagaacaaacaatggcttccagcactggagcagacccctgcagactcagtgacccaggcaacagcattctatgtgcaagataccggaaaatcttcggtgaatggctgggatgatacaggaggtgaagggggcactagagagatgggagagcaggtatttaccaatcagaatggaggtatttcaatctgtaactaagttagatgactgtgttagtgctcaccagctgagcaacagcccttctggaaccgaagcattgggagtaagcctgtctgtgcatctgatgccacctgggtcacctgataaaaaatcagattctatgtcctccattcagattcaaatttgatgattttaggctgagtctgggaataggtacattagcaaaagtcttcagtgacttcaacttggaaatgactgttaacatgccgggcaagagggtaggctttgcagtttggcaggtctgggtcagtactctggctctgacgctggcttaatctttgaggctcactttactcatctgtaagatggttgtaatgatgacgtttgtgaggattatttgagaaaatatttctgaaatgcttagcccagacctgacatagaaaagatagtaagtctgtatctccccattcctcatccaaaacaaaccaaaaggaaaactctaactgaactttctaagatgcattataggaagcaagactcctgggacccaccctatttcaaataagtcaatatttctcaaggcgagaatttacattttaaacaagcacccgacatcattcttatattcactaattaaaaataaatattgctgcagttggagaaaaaataaacagtcacctcatatcacaaaagcggggtgctgctgctctgtcaacacaggcaggttcttctaaacacagagagcatgaatgatggaggctctggaggaccaggggctctagcaccgagtctgctcgtcagtacgctccctgcatcttgcatccactcccgtgggggatgtttaacctcatttaaatacagacatgaacccccttccctcctggcacaccgtgaagaagaaatgagctaatggatatgcagtgttcatgcctaagagagcattctaattaatgacataaatcaatagtcccatgggttgggtagaaggctttcatttattttcttctttaaattttactaacattttatttatttatcactcttttcccaactataaaaatcctatgacaatggtggaacaagtgaaaaataggaaaagaacataaagtggttaaaaaatgttacttatccaggtacaatgactacatcatcaaaagggctttccaggccaggagttcgagaccatcctggccaacatggcaaaaccctgtctctactaaaaatacaaaaaatttagttgagtgtggcagtgggcacccgtaatcccagctactcaggaggctgaggctggaaaatcgcttgaacccgggaggcagaggttgcagtgagccaagatcgcaccactgcactgcagcctgggtgacaagagcaaaacttcatctcaaaaaaaaaaaaaaagaaaaagaaaaaataaaaagggctttcctgtgaaatcaaagaagatgagtatcttcttacaccatgcctagaaagaaagaaagaaacagtatagcacagtggtcaaagacatgagctctcgtctgagttctaccacgtgcaatgtgacctttagccaacttactttacattttttgcctcagttttctcagtaaggtgggtgtaatggtattccctactggataaaggactcacaataaataatacgatataataaaatgtgtaaagctctttaaactgctcaaaagacattaggctattatttcaataatacgttttgatcaagggagaaaaatagggtcagaaaacccgattgtgtataggtgttgtctattctgatgggtcagtttgtaaatatttcggctgtcatcctgggaataatagttgcagctaatattattgagcttttacagtggccagccactattctaaaagtatttagccctcaaaatagctttctgagattggggatataaagtccctatcctattctactgttttctaattttttctttcttacctgaaaagtccacctgtcaaagaaactgattccggctcaaatcacaccattgccatccagatgagcacacctagagggacattttcgtctccgctgttgtttgagggagtgatgtttgtgatgtcacttttgattgtttgctgcatgactaatcttaaatatttgtttaatatgcaaatgatacctcccaatgacagctccagggaaacggcagatgtctttccctgaaaatgacacagcctcactgctgctcgcactcagttactgacactgtgttgcttcaactcagagctttgatatacccagtttcattgcaaacgcactgacttccagcaaaaaaaggccactgttagcacatacaacacctttgtgagaattagaaaactgtgcttcctctggacagataaattagaagaaagtaccaccattaccactcccccaccgcctagtagaaaattagaaaaagctattcccatctcagtggctaacacaggaaaaactacccttctggatgtacctaatatcaaagggtacatggcttggggagtagagaaccagctaccttttgggccactacttaccttcttggccagacatccttgttcagtgcacgacctgcaaaaccatatatggcaaccctgatccagagtcctaagatttttgtgcttctgaatttctacatattgtggaataaaaatgttatttcaacagattggcatcaaagaccctcttaggaaccaagcttgataggaaaatgctttgatgggctactttatgtgcagaaagacccctcatggaagaagatggctttataggtagagtctctctctggttaacaggaatttggtaggaggcaggtggaggatggttaggctgagataagaggagaggaatgagaaacgaaaagggaactaagtaacgggaagatggcacctgtagagtgataagttcctgatggcaaggtggtcagagggctttttttttttttttttgacaaggatgtctaatattccagtttaggttttagggaggttatcacacaaatctcttctgttgccttaaagctttaccaccaatctgacaaatataaccttgactcaggccagtgcttgcaaaacagccaagtgaccccaaaactgatctaattcacaaaaggagaaacacaaatgcagagtgatccgagaagcctaattcatagaagctgctctgcaccatactgctgagagtccttgagggatgggaagagactctggctctcccaccatatatggagtaaaggtagagtcaatttcacttaaatttcaagggataaggtaaccccagcagacatcaagtttacacatgtcagcaatgatcatggagctttggctgtcatctctctacttctgtctgaattgtgatcatcatagttcatagctaccaagtgtctaataggtaccaagagctgaatatgtatgattttaaacttcaaaacaaacttagcgagatgagtatgtccacatttgagagttaatggccttggaggtaagttacatgttcaaattacagaagtgttaggtaacagagctaaaagatgaacccaaatctctccagctccagagacaaactacctttcagtgtcttgtgggagtgaattcgtatctgcttaaactgtcctttccaaccactttagaagaagagcaagttcctggggctgaatgtgggaaatacttatagctggaaacccacacatgtgagcaattttccgttaccagaataaaatcttgctaattttggagataggccaggctaaactgggtaagaatctgaattttaagatggttcttaaggcaagtataagtgtaggatatataggacagttaacagttgagtcccctgtgttggtattagttctggtatgagtttaaggaatgtgagaatcagacccagatggagaccaggaagggaaatgccttcctccagcaagaatggaggctttgttgagtcccaatttcttcttcccagccggcattcccttaactctaggagtacttagcctggtgtttggagagagtaattgctttcatttatgtgaagagcatgcagcatatgcaatgtgtgcctaattaccctgaagcatggcaacaatgatgcttatcattaaataggggctggatcaccttcgttagaagtttttcttgatgtcaacactacattccgtcatgcatgtttagacttcatggctttttaaatcatgttgtagtgtggttacaatgaagataaaagctagaggaaaacactccatgcaggaatgccaaggagcaggagaaggaaaatactgttttccatgtgccagacacactgtggcagaggcagtggcttttcatgttgacaaccgaatatctggcactgttttctttttaagttctgggacacatgtacaggatgtgcaggcttattacataggtaaacatgtgccatcgtgttttgctgcatctatcaacccatcacctagatattaagccccacatatattagctatttatcgtgatgctctccctccctgccccacggcaggccccagtgtgtgttgttcccctccctgtttccatgtgttctcattgtccagctcccatttatgagtgagaacatgcagtgtttggttttctgttcctgcgttagtttgctgaggatgatggcttccggctccatccaagtccctgcaaaggacatgatctcattcctttttatggctgcatagtattccacggtgtatatgtaccacattttctttatccagtctatcactgatgggcatttgggttgattctatgtctttgcaattgtgaatagtctgggactgttttcaaacatcccaccccctaggggatggcatcatccctcgctgataaccactagcccaaatgcaaacatcactgaggcacgagggccttcagacagagggccaaagggaaacctgggaatattctaatggcattccagagggagggcaatggagggttctgggatgtggcgccatactgatattccagagagaaagctgagagatactggacatacagtatcctagtgacattcccaagaaagaaagtactgtggggcatctggaaagcatggcaacatgaatgagacatctttctcctccaatcacaggtctaaccttgatgtcatccatgtgcaggtggaagcaaatgaggccataggttctgcttaaatccctccagagagaactggggaggagacttgtttctccaaagctaggtaaatcctgtagctgcaggattcaaacagcagctcctgggaagaactggcatcttagagatctgtgtctttctgagaaagctaaaattagtttgtaacagtgtgtaaagtcctctggaggccaagaaggagctctccctgacactgagacagggaagttcaagaggtcagaaaggcttcttctaggtgcttctgcaggggctgacccgcctaaccactgcctcactttcaacccacaggggtagagatttcacctcctatcatccatgaagctggaaacctaaaaggccaacaaattaatatactgtcactactaataacagcaaacgctgaaatagctttagccttgtgccaatcaggtatttgaaggatattagcactttttgaaattaaacttgttatttttagataagtgtagattcacatgaagttgtaagtaataatagagaaaccccatgtaccatttatccattttcccctaatggcaacgtattgcactacagcacaatagcacaaccaggaaattgacattaatatagtcaagatacagaacatttccatcacaagaatccctcatattgtgcttgtagagcctctcacacttcctaccccaatcccctccttagcccctggctgccactcatctgttccccatttcaatgacttttccatttcaaaaatggtatataaatgaaatcatatggtatgtaaccttttgagactgcattttttctctgaacacagttctctggagattgatttggattgttgcatgcgtcaatagtttgttccttttatcacttagtagtattccatgatatggatgtgccacatttctttcttttctttttctttttttttttttttttttttttttttgagacaggtcttattctgtcacccaggctggagtacagtggcagtagtgtgatctcagctcactgcaaccttcacctccctcattcaagtgattctcctgcctcagccttccggagtagctgggattacaggtgcataccaccacatccagctaatttttgtattttaagcagagatggattttcaccatgttgaccaggatggtctcgaactcctgaccttaagtgatctcccacctcagccccctgaagtgctgggattacaggcgtgagccaccgtgcccagccagctgtgtcacatttcatccattcccccactgaaggacatctgagttgtttccagcatggggatattaagaaaaaaagtgcaataaacatttgtgcacagatttttctacaaacctgctttcatttatctgggacaaatgcccgggtgtaccattgctgggttgtaaggtagtggcacgtttacttttttaggaaactgtcaaattgttttccagagtggctgtgccattttataatcccaccagcaatatatgagtgatccagtttctccacattttcaccagcactagattggagttggcatactggacagaatcaatatgttatccttgtgctaaagcaacgaggaactttccaggaaactcattagaaggttcctagatggagaagaaatgaatccatcagctcaccatattttagaatggatatatttgtcagattagcaaggcagagaaaatgcaggaagaacggatctcaagagagatgagttttgttggggatgtagtgggagaagttcagaaaagcttgtgttgttcaggacaatcacagcaacgctacccaaagtgctctgtgtctcttgatggtaaagtgaaaagaagagacagcagccaaaagcaaatttcacgaactctgaaaacccagatactcagggatcagttccctgaagtctactcaatcctactgtctgcagaattcttgcaatcaatagcacagtaaatactccagcgttagtcaaccagtggctcaatctctcaaatgcaccggacttgtccacttccatctttctcctccacccctcatttcagccttatcttttccctctctttttggcgccaatatttttatggatgcaacagaacttggtccctgtactgtagcttctattgctccatcagtcttcctcctccattcactcagaaaattctctttcctcgtggtaccaaattgttttcccatctcaacgcttaaaactttgattccaaatttctactatggcaaagagtaactgtgataaaccaaagagatggtatgaaggtatgagggatgattgggtagggctcaacagaagaaaaagcaattggagaaaaaaaaagccacaacaccttcattttgagcatattaaaatagctatttttactgagggattataaatgtgccaggcattgtgttaaatactttatcacagacaatccttcaaacattccaataagatatgtactatttttagatctcccttgaaaataggaaaagtgactttgagagatgaagttacatggctaaggtcataatactgtaagcagggaagccaagatccaaacctaggcagtcttttccagaacccttgtcctgtccaagatttatcaaccaagaaaaattcatttagtatcagctcagatattgagcctgagtctcctgtagccaggatataggttatattgtgtgagagaaaggtaaggaaggactgttccaacatgactggccatggatgtagatcttatctgggttccgggactgtatctggcttccttgagccatcttagatgcccttggatgcccagactaggtctgggcaccaacctgggtgagattcccagcctcacccagcctggtgcctgatatctaattgaaagaaagaggagccattcttatgactgcatagagggacaatatttctacaaaaacctacatattaaaagatcatttggacttccatttctaatcaaatggatgacctaccatccccctgaaaacaactaaaagtgctgatagttagaaattatcaggcctaaatctaaggaaaagcaggaactcagaaagataaacagagtgctgatccactttcgtcctgaaagtatttcccaaatctgatgagcttagacttcatgggggaacaagtgacttattaccaagcctaaagccttcccaaagtgggaagttaaatgcaagattctaccaaatatgggaccccaagggttataatatcagtgtgaggatgaaccagacataggtcccaagccccagagtctataagaaaattttgtttcacaacaagcagagcaaggaggaaaacaccttctctaaaaagacataaccacgggggttacagcccaaaatgagccacccacagggtccaacaaactctaagttgtgaacgagtttaacacatttgcagactctgccccaggtgtccagtagaggcaaaggaaaatgctctcagaagaaggtgaattccccccaatcctcaagggatgaccacatataaaaatccaaggaaaataagcagcacatagtaataaatatttaagcacacaaggacaaaaggcacaatgagcagagcataagagacatagagaaacaaccacgggagattcttggaagatgggagcaatggcaacttcgtgtttcaatctctttcaacccctacccgaaagcagagcagttatatagaaaaactaaaaacacgtggccaacatctaaacaaccaagaaccccaaattacaagagggtggggacagaccactaacagatacaagacccacacagtattgatatctgtagaacatgggaaagaaggaagttataaaagcaaaatatgatggacttggaaaaaagtgaaccccaaggtagccaactagaaagaaccaaagaaacaatgccttaaagaaacagagagtggagaggaggaaatattaagaagacaaaaagaaatgaagaacacagatatttgtacacccatgtttatagcagcatcatttgcaatagccaaaaggtagaagcaacccacatgtccatcatgtcacgcctgtaattccaacactttgggaggccaaagcaggtggatcacctgaggccaggtgctcgagaccagcctgaccaacatggcaaaaccctgtctctactaagtacaaaaaattagccgggcatggtggcgcatgcctgtaatcccagctactcgggaggctgaggcaggacaatcgcttgaacctgggaggcagaggctgcagtgagccaagatggcgccattgcactccggcctgggcggcaagagtgaaactctgtctcaaaaataaataaatgaataaataaataatttaaaaagcacagtatatatgcaatgacgtattattcagccttaaaaaaaatgaaattctgacacatgctacaacatggatgagacttgaggacatcatgttaagtgaaataagccaatcacaaaagaacaaatattgtattacttgactcacgtgaggtacttagagtagtcaaattcagagaggcagaaggtagaatagaggttgccagggcctgagaggagtaggaaatgaagtattgcttaatgggtacagagtttcacttttccaagatcaaagaagtcctggagatggatcctggtgatggatgcacattatgtatttaatactactgaattgtacacttaaaaatggtgagggtaaattttatgttttgtatactttaacatagtttttaaaaataaaataaattttaaaaagaaatgtagaggggaaaaaagagagtaacaagcattgaaaataggcaatggagatcaaacagatggatagcaggaatttgtgtacatgaaaaccaaagcaaagggacagaagaaaccctaaaaatgatatttcaagaaaacattcctaaaattaaaaagaaattatttgaagctacatttttaaagtacacaatgcaaacatgagaatgttgacctggaataattaatatttagacatatcctaatataatatgggacttaaaatattctttcagcatcttgcagaaaagaacatgtaacttttaagggaaagaaaattagatgagtatcaggcattgaaagccatactttatgccagaagaaaattgagtaatatatataagatactcaaaggaagagagcatcaaggattttatatccagcaaaaattgattttcaagtacaaaagccatagacaaacttatcacagctcaagaactcaagaaatactgtttttctaagcctttcctgagtaatctactgtagaatgagttttagacaatcaaaataacttaagggtaaataacataatgattgctaatgagcatcaaataaaaatcaattaaggtaaatagaattaagacaaaatgaaaacaaagaggggaaggaaatattatgaaaggctatatgctctggcaatgtgtatatagtatagctattaagaatgatgagactaggccgggcacggtggctcacgcctgcaatcccagcactttgggaggctgaggcgggcagatcatgaggtcaggagatcgagaccatcctggctagcacagtgaaaccccatctctactaaaaataaaaaataaattaaaaaaagaattagccgggcgtggtggcaggtgcctgtagtcccagctactcaggaggctgaggcaggagaatggcgtgaacccgggaggcagagcttgcagtgagctgagattgcgccactgcactccagcctgggcgacagagcgagactccgtctcagaaaaaaaaaaaaaaaaaaaaaaaaaaaagaatagtgagactatataggttggtcataattcgtagatctgtgtacctgaaatggataactttgctgttaccctaaattttagctcaatgaacttgaaaaaagaaggggataagaagaacatacaccaaaaaattttaagtgttttaagtaatcataatggagatgatatgattattattatattattactattcagggactgttatatacgtaaaattggataaaatgaggaattataattttatcatcctctaggtccttgaaaactaagtttcttggaatggaagagtacttattgatataatagaaatgaggtttaaaataaaacctcagaaatcttgacttagaattagaaatatcaatatgaatccatgagatattttgtatattatgttataatttgtttcttaaaaacttctagagacaacaaccaactcaacagcaatgaatatccctaagtgcccaagttatggtcttgaaataccattcatctaaaagacaccagggcttcttggagaaatagctgattccaagtgtgggatcagaaatatacaggactagcctggaatacagtataattccagataggattacagctgtcaaagaccacaagggtcacatagaaaaggcccagtagcaaactcaaacaggcttgcattggcaaagatgggagaagttgaacttcaacaaagataataaggggtagtgaattaaaattccagtatgttgaagcctatgagttcataatgcaatttgtaaaaagaacaaacaaacaacaacaaaaaaactgataccttttggggatgacaagaaaccaattcattatattgaaaactggtaaataaagaaaaataagcacatattctgcatttttcatgtgaacatactgggtaatcacatagtaaacgaaataaacggcctctgtcaaagtgcttgactgataagtgaaacacaaatcatagcatcagaacattatcgtgttaggctgaataagagccccctgaattgtccaaatattaatccctagacctatgaatgctatcttatatggcagcaaaagggtttttgcaggtgtgactaagaatcctgagatagggaggtgatcttgatgggcaagatgtaatctcagggttccttataggagggaatcagagagacgaaagacaaaacagtagtgaaagcacagagaaatctgaagatgctaaattgctgcctttgaagatgggtgaaggggctatgagccaaggaatccaattcccaactctggaaaaggtaagaaaacaaattcttccctggagactcttaagggagcgaactccttagtttcagcccaatgaacccacttgggaccttgggcctatagaactctaagaataaatttgtgtcattttaaatagctaggtttgtggcaatttgttaccacagccattgaaagaaaataagacaatcaacattttgcaaccaccaataaataaatatgttacaattttaaaagtaaaaattaaaaagaaacagaaaaaaggctgagagattaagaaatactgaaaacaggcaacagaggctgaacacagggatagcaggaatttgtgcagatgaaaaccaaagcaagggaacagaagaaatcctaaaaatgctatttcaagaaaatattccttaaattaaaaaaaaacaatttgaaactacatttttatttatttgttgttgttattatttttaagatggagtcttgctctgctgcccagacgggagtgcagtggtgtgatctcggctcactgcaacctctgcctcctgggttcaagcaattctcctctctcagcctccagagtagctgggttaacaggtgtgtaccaccatgcccggctaatttttgtatttttagtagagatgggttttcaccatgttggccaggatggcctccatctcttgaccttgtgatccatccaccttggccccgcaaagtgccgggattacaggcaagaaccaccgtgcccagctgtaatgttcactttataaaaattcattaaaccatacaattgacttgtgtgtttttctgtatctgtgtgttgccttaggactataattatgacgtttaatgaaataaaatacaggcttcagacagccttcattaaacagaagactattaaatagatgacaagaaatcaaaaatctaaagataaaacatatataaatggtttaaaaaagtcaatgagcaggtttaacttcagattagatacaaatgtagaagaataggggaactggaagacaagtcgaaagaaattatgaagcagcagctgagagacgacccaaacagaccagggaattctaacgtatttataatcagaattcaagcaggtgaaggcagaaagaatgaagaaaagcaaacctatgatgatattatgagaatttttcagaatgattacaggagagtaaacacagagtcaaggagcccaataaatatccagcaggaagaaaagcaaaacaaacaatgaaacccctcatctagacatgtcagactgaaatggcagaatactagctacaaagagaagaacataaaagaagtcagaaaaaaattaccttcaaaagatttacagttagccctacagctgacttcattagtaacaatagaataaagatcattctgaaggcttagtctctgaagatggcaagggggaaaactttaaagagggaaagacttcagattttaatttaatttctgcaggcctgtaatgcatctcattaaaattaccacaagaaggaaagaagaggaaaggagggagaaggtaggaaggaagaaaaagagataaggagaggagagaggaataaaacataaatttaagtgcagagtccttaattcctgtctggccccatatcacaatattcaaggcagtggtggcctaataaatgttttaacagatggatctctgaaacaaaaagccaagattctgtagcatttgccaatttctatggagaaagcacccatacaaagcctgatttcaagctactaccatgacatcactgagcttggatttgggaagttatatgcatagtcagctccctcaatctggtaggaggagatggttccaacaccgttgctggtttcaaggtctcacacgctgctattagtgggccagtccaaaaatcaaatctgtatctctcaaaagtcccaatcctttcctcttgatgcatctaaaaatgtgattaccaccttcttggtatgaagaagcccaggttcaatttagagcgatttcagtgtctggaccattgcgagggaagttagttgcttagtagaggctggtcttgtaggtgatgtccaaagtatactagcttaggagaagccattggtcctctagaagtcataggtactaggcaaaaatcttttcttagaaaaaaacaattatttgacagtgtgctgattaggaggattccaaatctaaataagcccagtccttcaggttaaaagtgttttgatttcctcacttaaccatttacacacaccacccaatatagtctaaccatagtgcaaaaagttatcccacaggcaagtttgtttacatgtttgcagacactgtattggttttcaagtcgaaagccaataacccctatggaacatgccctatagattacaaaagtttactaaaaactgttaagttttaataatagactacaacttgaacacttggcatattctgtaataagaaaaacacaaacttatgtacacgcatacaacttcccttatcttgtattctagaaaatgagaaagattggagtagtcatgattgggcacagtcccatttcatgcaagtttaaacttccttgggttgggactagtttcacttgggccacctcttggtctactggtatgagaaattagaaatgtagagatcctcgggcacccccagaatggcttagtttagagtctactaactgtagcattggtgaaaaacaggccacggggggatagccctatttgaagccttctcataggttgaaaccttagatgctttggaccttagcacttagctaacacacagctgcttcctgccataagctaactgccgacatacaagatgagaagtcttcctaaggtctatgtatcttagacgcccagaaccaccatttgctatgtttttatggatcagtgccaaaaagagaccattggtctagtttctctctatgcttataattactttcattatgattatcccattactctgctcttccactgactcttagttaggtaccctccagccctcttagtagaacgtcttaagtgaaataatcgggaccaagtattgtgggaatgttagcgtcttcttagaaaacccctggcctctatatgcaaagtgcccttctcccctttgcagacaaagagaagtgtgtaggtagggcctctatgtcaaatcgaagacctcattataatagtttccaaatctaggtctgctcagcttatatctgcttattaaagagcatagacagctgctctcaattgaccttcttttccccaccagaatgaagagcagctggcagcttctttagctaaagaagggaaaaatctggtttggctattccactccacagggactcagtatgaacctactgtcaaaatcagggagaagcttccactaacaagactgatggataaaactgaaaatgggcatgtaaatgtctcactagacatactgtaggacactcactctccctacagccccttgtatctcctgcacacatctcttcgacaaccttaccactgtctcagacatgtaaggtacttgccaagcagaaagaaactgttactcttcagaatcgacacttggtttagtgttgtctaggccacatccatcaatagcattctttttgttttaagttctggcatacttgtgcagaacatgcaggtttgttacatcggtatacatgtgccatggtggtttgatgcacccatcaacctgtcatcaaggttttaagccccacatgcattagttatttggcctaatgctctccctccgctatacgcccccacccccccacccacccccacaggccccggtgtgtgatgttcccctgtgtccatgtgttcttattgttcaacttctacttatgagtgagaacatgtggtgtttggtttcgtgttcctgtgttagtttgctgagaatgatggtttctagcttcatccatgttcctgtaaaggacatgaactcattcttttttatggctgcatagtattccatggtgtatatgtgccacattttctttatccagtctatcattgggttggttccaagtctttgctatcatcaatagcattcttttacatccaatcaaataatctaacttggagaaaagtactggccagaaggtaagaggagcagcattcttaatcctaagagatgtgtctacacacacacacacacacacacacacacacacacacacacaccacactctcagccagatagagtcactgcagcagtacatgccgcaaactctattttcttcttatgcttattgtttcaacttttcagaaggtcagaaatgtaaacagaacagtggctctcaaagtatggtccctgcaatggcagcattagtatcacctgggaacttgttagcaatgtaaatcctcaggcctcaccccagacctggtcaatcagaaactctggggataaagactagcattctagtttaaaacacctcccaggttgccaagtctgtcctgcataacccagcccatggatgaaatgagtactcagacacaggtatgcagtgtaagagcagctaggtgactgcctggctctagtggccagagagcagccctgagaagctggagctacttgctttcagtgcaggcacaatgccgaaaacctggagcccacaaaacctgtaggtaattaatatttattgttcccctttcagggaacatcacacaaataatcaaaagtcagttcctggtcaacataagtaaacaagcttgtttaagataaattcccccacactccgttgtacctacttcttgccctctgtctcaggattatagaacagctgcctttagctattcttcccccggggatttgcagaatcttctgacctttcagaaggtttgcatcctttccctatagtttttcctaccactctggccaatctcccatatcaggtgattctattctagtaacagtaatgtttaagaactagtggagtaaatgatgctagaaccttcagtatagccaagctagataaaaaacatttttctggaaaattgattcaacagcacccaagtagagagaaataatctataaaaaatccacacattctttctgtttgcgaccactaaatttggatcactgcctccatgttcgagtgcaagaaaagaaaagccattcacaatgagcccataaagaactgctgcaggacacagaaaagaaaatgccaccatgaacacttggaagaaaatagtggagttttctcaatgtggtttattatagaaagaaaagcaaatatataaaactatttgacaaacagtcattatgaaacaggagcaaaacatcaagagagagactaggttaagctgaaacacagaatgtgataaaaatggagtgtagttagaaaatagggaaatttaaatgtgcaataataaaattaaaaaacacatttaatgttgcaacaaccaggattgacaatgtggaaaaatgagatcacaaatgttggagacaaactgtaagaaactgacaaaatgacataaaaggcccaaacagtggctcatgcctataatccagcactttgaggggctgaggtgcacagatcgcttaggcccagaagttcaagaccagcctgggcaacatggagaagtcatgtctctactaaaaatacaaaaaattagccaggcgtggtgatgcatggcctgtagtctcagctcctagggaggctgaggtgggagaatcacctgagcctgggaagtcgaggctgcagtgaggtgtgatcaagccattgcaccctaggctgtgcgacgagaatgagaccgtgtatcaaaaaaaaaaaaaaaaaaaagaaaagaaaaagacaaaaaagatgacaaggatgagagtagatggtgaacagaaaatcttataatgtgaactattcctgagaaacatatttcaatgattattagccattgtagcagtgcatgcagagagtttgttttttatatgcctatatgttaacatgtcagagagccagaaatgctacagaaacagtaatcagagatacaacagaagatgactttccttaactgactaaagccttgaattcacagattccaaagtctcaacatgtttcaggcaacaatcattaacaatgagaacactcaaattttcacctgggtggcagaagtaagagtaggggtgggagctggggttgggattagaggggttgtcacttcagaaaactaagcctgattaacttggagatagttggggactctacgtaaaataccattcaggcaattcacattggcaatttacttcactatgacttgttccctttgtcagaagagccctgttatttaggtacaagaatttggccttaaaaacccttttcttgatcaggatttattgcctgatgttgaagttcaattaataatgggagaagatttgattgccatagagcagctgcctggatgatgggactatggatgacatttttccacctgtaatttccagattatttcctgtaatgagaatgtgttattcatttacaaaatatccatggcaaaagtactgagtatcaactatgtgcttggcactgtgctttttctttctctcttggtcttattcttccattccttccccaccccacaatcaccaacaaataattatccatgggatccaatatttacaacctcacatttaaagaaaaaagataggccgggcacagtggctcacatctctaatcccagcacttcgggagaccgaggcggacagatcatctgaggtcaggagtttgacaccagcctggccaacatggtgaaaccccgtctctactaaaaatacaaaaactagctgggcatggtggcaggtgcctgtaattccagctactcaggaggctaaggcaggagaatcgcttgaacccaggaggtggagattgcagtgagcctagattgtgccactgcactccagcctgggcaatagagtgaggctcagtctcaaaaaaagaaaaaaaaaaagaaagaagaaaagagtttttttttctatcagctctccatataaaaattccaggataagtttctgattggcctagcttgggtccaatcactgtgagagggaggaacagaaatttaagattgtccagtcctgggctgtatgttctgtaggcaagatgctataattttcaagttcattcaaagtacatgattgtattttttgatcattccacaatgcatacatgtattgacacatcacattgtaccccattatatatttatcaattaacataaaactttagaaaatgcaagctacaaaatcgaaagaaagacacatgactgtaattaggaaaaaaaaaataaggaatttgaaagggagggtatttcctttccccagaagaaccagctcatcactgttaagaagtcacaaactatagaggtcttccactacaatcccaggtccaagagacgccgggatatcttgcatcaccattcttacatatcttcctaaagtctaccatcaagacttaaacatgattccataagcaacatctgcaggactggcagctgtctgaatttgattgatactctggcaagtcaattttgaaagcatatagagctgagaatattatcttgatggtatttcccactacattccaaagttcaagagagtttgggttacctctctctacccttctgatttattgccctctaatggaccagcacaagttaaagactatcttgtaatcagcagcagctagaggcatcggcagctgcctgaatttaatactctggtagccagttttgaatgtgcatagaattgagaatattactatctcaggttccatattctccattgattttacacaatcaatgattgaaacaaggtgagtgctcggcaacctgggaggcttcaatttatcaaaggattgtcattccagacagctgctgcctttcctgatctggatgatttagaggatgacagaataatgaacgatagcttaagtgttgtgatccttcactactgcccttcaggcagcgctcaaaaacaacaacaacaacaaactccgagttctcttgcctggctgttcctgcccctgaaatagggtgactagattcagtaacagttgttttctttaataaaggatgaattaacacatgttaatgattgtgcattgttaacttaccagaccaggaggaaggagagttgactgggccacttagctgacattcatccttttcctgtttagggtgtccatgttttccttcatgtaatcacttctctctgactcttcgttcatatcctttgggtggagttgaattcatttcccattctagggatgggcatgtggctccaaccagacccatcctagcatgcactactgtggttatagtgattggttcagggatggtcacatgattcaagttgaaccaatgagatataaatacacgtcatggttaaaggatcggaggtacaggttctccacagctgtattgaatctagaattaaacttgccatcccacggagtctgagaatgaagccaacacagaggaaagtattctggcagatgaagagaaacatcattctgattacatagtttgaacaccttggtcaggcctcacctgaacctagttctggtcctcaaactttcatttataggaattaagacccattcagggttggttctctatcaactgaaacaaacaaaataaagagctctacacttaggttcaagtccaagccctgccacaaactaacagtgtgacgtggagcaagcctctttattcctctaaatttaggttttctcatctatgaaatgaagtcattagatgaggcagatatttgagctttggcattctagggtattgcactgaattattgtttcaaatatggatttttgtcagaggagacaggcagaacaacccgaatctaggccctcaggaaaaacagatggattggagcaaatgtatcaagaagtctttgcagaaagggaaaaggatatttgaagtgtttggtaggaagagttgattctccacacacttcaatatttgaagagttaattggtagcagtgtgtgtgtgtgtctgtgtgtgtgtgagacagagagaggagttatgtgttctttataacattcaatcctttgaatttcttccaactgctaagtttgattttgtaatattaaaaagatatagaataatatgaaaaaaatggctaaatgtaattatgaccctggactactaggctttattatttttggaattcctgacatgagcttgatgtattattctagccctaatgtccctgaggctagactttgagaattttttacaagagtgaaaatttcaaaatagtttagcaagtgacctaaggctaacatttcataaaacaagagtattttaatagagcaagaataaaaaatagtgggacattttatctttaagcaaagaaaattcttccttagaaaagatagttgccaatctaattcaacatttatatctttctttcaagctttctttctgacttttccctatggtctcctaagcaacatatagttaaatttccctgttaaaaatcctaatagtgtttgtcttttaatagaagaaattaagttatttatatttactgtaatcactgtgtgttagttttctttctgtcatcttaatttatggtgtctgctcttctacatctcttgagggttcccctttctagattctagctaattggtcaaatgttctttcttcctttcatttctttggtgaaatagaaatgtttcctcttttttgtattttaacttatatgtatatttttacaagcataattatgtttccaatcctgttttcttagcaatttcaaaaataaatcaatattctgaagcctactctcacccacgtactaaaaaggcagtctttcatttcttccctcctcggagattcatctcccaggtttcatcttgcagaattttggtgtatgattaatattttgttgtaggtatgcatggactttatctatttgattttatgtcatcccctttctattttattaacttatttagtaactgcattgggattttacacctgcattgtgagcaactatttgtacgctccccctattatttctttggcttttcttagttccattatgtctgtctagaagcattctaatgaaccttgggtttcctggacctatctctcatctctcaacttttccaatgtaatttttatgttattggagagaatgctttagctagatattccatatcacaaagtcactaagtcaattcattttttttcttttttttttgacacaggtcttgctttacctcctgggcttaagcagtcctccctcctcagcctcttgcatagcttggactactgatgcatgccaccacacccagctagttttttaaaaattttttgtagaaatgggggtctcactctgttgctcaggctggtgttgaactcctgggctcaagtgattcccctgcctcagcctcccagagggctgggattataggcaggcatcactgtgcccaacctcagtgcttttacttaatttttacttctgccgtcagcctttccattttaattttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattttaatttttaatgttatcaattatattctaatttccaaggttttcttttttgggttatgaagttattcttatgaattactccaggtttttctgtccagtatggcagctatttaattagctacatgtggtagtcactagccatgtgtggctatttcaatttcagtttaaattagttaaagttaaatgaaattgaaattcagttccttcactgccctggccacatttcaaatgctcaatagccacatgtgggtggagactgcagtgttgggcagttcagagttgtacagcattttcatcatcacagactgacctgttgtatagtgctggtctagactgattagtattagctgctaaaatggttttccttccaacgcaaggcagtcactgtcccccaggtagtgaaaatggctgctgacagagcaggagcatcgccatcttggacaaacaccaccattttacgttccccacgctcctaaccaaaatcggccaaaagcccctctcaggtttattctccaaaataaatctgtctttaactgttaagccacttttcatgtttctttcctctttcactcttagagctgccttgagtggagaagagctacatccatgtgggcttccctgcatgatgggagggaaacttgacttctcattgtgaatgctctgtcttagttgggttcagcacaagttacttggggcagggacccatgtcctctccagctacctaaacttcagtcctaactttatgcagaaaactgacttcacagaaaacctaggagcaaggtgctgtagccagcctctctttcaaatggggaattcgtgtaattgttctgttgttctctaatttataacccttagaccatcccacagaccattgcttctcccagcctgctgtctccaatcttgatttttctccagagctctgttggaagaactcagttttacaactgtctcctctttcatctgtctggggttatggtctcctgaaggctgttaaggaatcaccattcatctgatgccatatattttgtctgtttcacacatttctcaaaacttctggcttgctgatggtgacattttccattttccagcattgccattgatttattcttgctcttatatttcctctgtcaagatgtgctcagtcagccatcttgaactgaaaggagtagccctatttcttaagcttttgtgtctacagaattagttttataaataatcatagaatgtcaggggagaaagaaaatctgagatccagtccaatccattcgttttatagatgtacaaagtgagactcatatgagaaaagtgactcacacagacctttacagcatggtaacggcaaagcttggacaaagagggcagtcacttgtctcctacactggcctctgaccattgtcccctgctccaagaaccctgagtcattataagaggtcaatgttgtccgggcacagtggctcacgcctgtaagcccggcactttgggaggctgaggcgggtaaattacgaagtccggagttcaagaccagcctgatcaacatggtaaaaccccgtctctactaaaaatacaaaaattagccaggtgtggtggcatgcgcctgtaatcccagctactcaggaggctgaggcaggagaatcgcttgaacctgggaggtggaggttgtactgagccgagagtgtatcactgtacttcagcctgggcaacagagcaagactctgtctcaaaaaaaaaaaaaaaaagtcaatgtctcagcccaggcataacctaggttcagcacagtagttgtttttttatgcagatcttttctaagctcctcctaatacaaaagaatgggggactcctattttttaaaaggcattttcaactgaactgaatgaaattaaaagaatcttccactgttggtgggagtgtaaattagttcaaccattgtggaagacagtgtggcgattcctcaaggatctagaaccagaaataccatttgacctagcaattcaattactggggtatatacccaaaggattataaatcattctactataaagatacatgcacatgtatgtttactgcagcactattcacagtagcaaagactttgaaccaacacccaaatgcccatcaatggtagactgaataaagaaaatgtggcacatatacaccacggaatactatgcagccgtaaaaaagaatgagttcatgtcctttgcatggacatggatgaagctggaaaccatcgttctcaacaaactaacacaggaacagaaaacccaacatcggatgttctcactcataagtgggaggtgaatagtgagaacacacggacacagggaggggaacatcacacaccagggcctgttggcgggggtgatgagcaaggggagggagagcattaggacaaatacctaatgcttgcagggcttaaaacctagatgatggattgataggtgcagcaaaccaccacggcacatgtatacctatgaaacaaaccttcacattttgcacatctatcccagaacttaaagtaaaataataaaagaaaaagaatcttcctcttaacctacaaattcatttactccaaaaggtccttttcccaagaacagttaaaaaaaaaatcaaggttatacttcaaaggtataagaagaaaggggcttggaaaatgcaaacagttcccgcttaggaatgaccatgatattgcagaatgggtgggagagcagtggatatgagaaataggcttcccccttccccagcaggttctggggtgggagcttattgtccatcttagtgaaatctttcatctcgagcatctgcctagttgcactcatctacaatctgtttccagtgaagcaaagtaattaattgtttcaaaatgcttttttagactttggaaaactgacctagggttaatggttcataaacctcatttatgcttctattagagattttaaaatgtgagctgatgtgcttctggactggagaggaagagaggccctcatagacctgctgtgaaacctgtagcagtggctgcagccaaggagttatcccttttttttttttttttttttgacatcttaaaggaagagagggggagcaacgcaaattctctgacatcatctctcagagggtttgatgtaacgatgacatattaaacttggagagaaggcgtacactttcccggtcctagaagtttcatcatcgaccctcagccactctacaatggggactggaaccaggctttccagtcctggcagagctcctgttactatgtattcctcgataaaacaccttcattcctgtacttggcctcatagactgtgatctttttagggataccagtaagggctctcaatatctcttctaacatgagcaaccccataacttcattcccgggtatcacaaagacttactttggggattatgaactcacatgcatccagacaccagacagatagcataaataagtcaggaagaaggatggagactggggaaccggaacaggcacatccccttcaaagggaggtcactgcttttcagttctagctggttgctggcatgcagaaatgtgtgccttatgtttccagaggagtcacaaatccagataacaagtgaagtctgacgcttatttggtgctggtgactaattaaaaaatcgagacacttccagctacaaacaacacacatctgtgatttcccccatcccaacccctggtttgagatctctggtttggttctcccagaaataactatcaaaatgcaaaggtagaaaaaaaaattacagaaggagcaggactggaaaagaaatgcaacgatgaaaggattacagaagcaacttttagataccaaatagtcagtgcctatgcaaattctaaacagatgtggttgacctggtgaagttccagcctccagaacactcccctcctggccaccaatagtggtctttgtaacatgcaaactctttgtttatttgaattctgggccaggctaaagtggcagtcgcctcaataaagggggagccttcaggaaggtgggtattcctaggatattctcaaggatagacaccctaagatattcaaaaagattgaatttccaaggtatacgcatacaaatcaattgaaatgtaaccatagcaattataataaatcacttcagttcaccaagtgcctatgtactaatgtcagggtaagtgacttatagaagtcgtcttgtttcgtttgcacaacaaacctaatatgtactataattatcccttttcctttttatttattttttattttattttatttatttttttgagacggagtctcactctgtcgcccaggctggagtgcagtggcgccatctcggctcactgcaagctccgcctcccgggttcacaacattctcttgcctcagtctcccgagtagctgggactacaggcacccgccaccacacctggctaatttttgtatttttagtagagacggggtttcactgtgttagccaggatggtctcgatctcctgaccttgtgatccacctgccttggcctcccaaagtgctgggattacgggtgtgagccaccatgcctggccataattaacccttttgtatagatgggaaaacacactcagggaggggaattcgttttcctgcagatcacaggtgataacacctgaattttgttagaaaatgagctccctcaatctatgtgttattctttgtctcccttgaggacacagagtaggaagttcaacataatgttgaagtggttttcccctcccaacttccaaagattcccagagtgggcttaaaagtaagagaacagatggtggttgggtggtggcggtggtatatcaatttcctccaaatgtatatctggaatatacaaaaacaaactagggtgagcagaaaaatcgcatgttctaaaaatgaaaagactgtagctttcaagatatttatcattttgtgtactctgggaccatatggataatatcaattggcctaagattggaaggataaggaagggagaccacaaaaggctttgagaaagcaaggggtagacactgagagggagagcatgacctggacagtgaattgctcatgtgggttgttgagatgtttatttattttatatttatttttttgagtgtcgttctgtcacccaggctggagtgcagtggtgagattttggctcactgcaacctctgcctcctgggttcaaccgattctcctgtctcagcctcctgagtagctggaattacaggcacatcccacaatcccagctaattttttgtatttttggtagagatggagtttcaccacgttggccaggctgatcttgaactcctgacctcaagtgatccacctgcctcggcctcccaaactgctgggattacaggcgtgagccaccacacctggcctgttgagatgtttaaaaacaactttattgagatatacttcacataccacacaaattgcacatttaaagtatacaattcaatattttcagtatttttgcagacatgtgcaaccatccccacagtcaattttagaacatttttaccacctgtaagaagccctgtgccctctagccttcatctccctgttccccatcccttccctgaaatctccagaaaaagctctagagttggctactcctgggatttccaggagtataagccagaagtcctctgccagttcgtttttcagtttaaacatcaccaatcaaacactgatgtccttgccctctttttcttttcttacccctacctttctgataacttagcattcccagtcctgacttaggagaagggttggatttataaacaattatcccaggcattgttcaagaggtctctatgtttagagtgggtctaaatgcagaaactagtacccagacctttctccaagcaccgtcaaaggcagtacttctgaatgcatcttcacaaccttttgttctattttctgcattatcttgaagaggctacatcattgtgaaaatgtaggaaataagtgatttttgttcaaagcaatgatgggaagtggtcattcttaaatgatgtctattaacgacctacaagtgaattgaaggtgctaggcattgcgagttgtgcaaagagattttaaactattttggggaagatagaatatgaattgtaactggaaggaacatgacatgggaacagagcattttcttaagaatcaaactaattgggttcaaatcctaatcccactacttaccaactgcacaacattgggcaagttagctaagcttctctgagtctcagtccccttaccaataaaatagaaataatgtcactgtattagtccattttcatgctgctgataaacacataccagagactgggaagaaaaagaggttttaatggacttacagttccacatggctggggagacctcacaatcatggcggaaggcaacgaggagcaagccgtatcttacgtggatggtggcaggcaaagagagaatgtactagcaggggaaatgccagacgcttataaaatcatcagatctcatgataactcactcactatcaggagaaaggtatggggaaactgcacccataattcatttatctccacctggccctgcccttgacatgtggggattattacaattcaaggtgagatttgggtagggacacagagcccaaccatatcagtcacctattctatatggtgtttcaagattaaaatatgtgggattgacaagcaccacaacaattattatttctactactactaccaccactaccaccaccatttaagtgagcatttatttgtcaagaagttataagtcacttaatatgtattatctctctaacccatccaacaacttggaaaagcatacaagatataatcctcccttcacagatgtaaaaaactggctcagataagtgaaataacttgccacaaaccatacagctggtgagtgtcggaactaagtattaaaaccagacttgttggtcacaaagatgacatcacacccattattgtcataattaattactactggaacagtgcaaggaggaatccagaacatgaaagagacatttttctttcaaaagctagaaatccatcttttaaaagtcaggcaaacactgtaaaatttaaaataggtaatttcacattttgatggctgtgttagaaactaggcaatatcaagtacagggcttaaatgccagtgtaaggatgagagactatgtctagacagctggtataccagctccaacacatcgtctgtgttcacccatccaccccacaggccgaaatgaatttttaggaagagatgctattcagtccctctgtaaaggggcttccagaacataacctgccattcctggaacaatgttgtaacatcccgggcagagaaactctgtcctctgctcagcaacaaaccttgggatttgcccagtttcttgtccttgggttcttgcaaagtcaccataatttgaatttttataaatcaaatcctatttcaaatgcaattgaagaacttgcactttaaaagaatcctgtcttgaatcctcaagaaaatggaagactgccgttgaaactgaatagctattcctaaaattatccattttgcaaatttggaatttggttcccaaccttgtgaaaacaacctgtaaacttcgaaaccaatttgaaattcaagtttgtggctgggtcttttgggcactccttatcaccttggctgataagcatttaaatatattcattaacaaaaatcattgttgtcacagttaactacattagcaccttttaattgaattagaaattagatgggggtcatgaatatttcactaggattcactgccagccttcccaatttccatcttaaaaaaaaatactgtcacgtagcgtaaacggatgaattcacaatgttcttgttcccgccttttcttatagttttgccacaaaagtcatcccggtgtcgaaaatgaatcagaaacaaatttttaactttcatgctgctcttctgtgcatcttggcatgatgcaaagagttttctgtccttaggaaactttatataaacatttactcaacacaatccagaaaccatcagtcccattgcatgctgagaaggctggggtttttgaggtagagccagattctcaatatcagcacaactgacttttggggctaggaaactcagtgggaggcctgtcctgtgcgttccagggtgcttagcagcatccccggcctctatccactgaatgctagtagtgcacatgacacgctccatcccctgtgtgacaactaaaatagtctccagataatatttgtttgtctctttgtttgttcgagatggagtcttgctctgtcacccaggctggagtacagtggtgcgatttcagctccctacagcctccaccttctgggttcaagcaattctcctgccttagcctcccaagtggctgggattacaggcacacaccactacgcctggctaatttttgtatttttcagtagagaaaatgtttcaccacgttggcctgactagtctcaatctcctgacctcaagttatctttgcctaggcctcccaaagtactcagattacagacatgagtcaccgtgcctggtcatgtctccagatatttggatgtccaaatcatatcccacccttgggggagaagtttgctccccagcttggaaccactaagaataatatagattcaattactagccctgcctcttgtgtttggcccttctctgggcctcagttttgttttgtatatgtgaaatagaagcgatcatcactacctcactaggttgctaagagatttaaataatatcaagtgaataaaaggcatagctgagggcgtgttcattaattaatatgtatgtagtaataatcatagtaacagaagcagcagcaacactagcagaacttgcatcatgacgtgagggaggtgaaggaaaggactagctgctcctcttctgtttatactacactccactcatggaagtgcccatgttactgggctgaaccacatgaaccttccctgccggaagaaagacccaagagggcaccttcaaaggcagcagtagcccctcgtccgcgaatctttaagctggtttgactcaccctccatgccacatgtgcggtggatggtcaaagcaagccccagatacgtctccagtggagacatctgagacagcatggtgaggtttaaaaaaggaaattggatttggagtctaagggacctaaattccaaacttggctgctgattctgggaagtgttgggcaagttccttaatttctgtgagcctcagtttccttagctttaaaatagagtcagtgaaaattctcccacagactggttgtaagaactaaatgtggtaacgcatgcagaaagcccagtgtgatgcttgacacacggtaagtgctcaattatctgtagtaattatcatttttatgatgaagaatatcatgatcctggcccagcatggtggctcacacctgtaatcgcagcactttgggagcctgaggcaggtggcgggtggatctctctttttttttttttttttttttgagacagagtcttactttgtcgcccaggttggagggccgtggcacaacctcggctcactgcaagctctgcctcctgggttcacaccattctcctgcctcagcctccagagtagctgggactacaggtgcccgccaccacacctggctaatttttttgtatttttagtagagacagggtttcactgtgttagtggcaggtgaatctcttgaggccaggagttcaagaccagcttggccaacctggcaaaaacccatctctactaaaaatacaaaatattagccaggcatgatggcgtgtgcctgtaatcccagctactcaggggactgaggcaggagaatggcttgaacccgggaggcagaggttgcagtgagccaagattgcaccactgaactccagcctgggtgacggactgagactctctcccccacaaaaaaaagaatatcatgatggtttacagcaaggtttctccaccttggtgctatacacattgtgagctgaataattctctgttgcgggaagctgctctatgcactgtaggatgtcagcagcatcactggctaatgagatgccagtagcacttgtccacagctgtgacaaccaaaagtgtctccagacatttccaaatgtcccacggagacaaaactgccccccttgaggaatactgctctacaggaagtggattcccttcctagtctaattggtcactgtatcctgggtggatgccacctcttctgggaagaccccctgccttccttatgcagaattcaccgctcccttcattgcctcgtaagtgtttgtttgcttatctgtgtggtctgctagactgggagccccacaagggccagcttcattcagatctgtgtctggagttggcacagagtggaaggtagtgaacagagcaggaaaggttaaacaaaaaagtggttaaaaaatcaaaagaggacgggcgcagtggctcacacttgtaatctcagccctttaggaggccgaggcaggcagatcacttgaagtcaggagttcaagaccagcctggctaacatggtgaaaccctgtctctactaaaaatacaaaaattagccaggcgtggtggcctgttgtcccagcaactcagggggctgagataggagaatcacttgaacctaggaggcagaggttgcagtgagatgagatcacaccgccgcactccagcctgggcaacagagcaagaccccacctgtctcaaagaaaaaataacaataataataataatcaaaactaaaaaataatagatgttggcatggatgtggtgaaaagggaactcttttacattgttggtgggaatgtaaactagcatagctactatggaaaacagtatggagattccttaaagagctaaaagtagatctaccattcagtctagcaatcccactactgggtatatacccaaagacaaagaagtcgtatgaaaaagacacacgcacacacatgtctacagaagcacaattctcaattgcaaaaattatggaaccaactcagatgcccatcaaccaaccagtggataaagaaaatttggtacccatacaccatggaatactactcagccataaaaggcaatgaaataatggcctttgcagcaacttggatggacttggaagccattattctaagtgaagtaactcaggaatggaaaaccaagtatcatatgttctcactgataagtgggagctaagctatgaggatgcaaaggcggcatacgagtaatataatggacttttggaattcagagagaagggtgaaggtgatgaggcatcaaaaactacatattgagtacagtgtaccctgctagggtgataggtacatcaaaatctcagaaatcaccactaaagaacataaccatgtaacaaaaaaccacctgttccccaaaaagtattgaaataaaatttaaaaaaattaaaaaataaactgttattttctgagcacctactgtataccaaagacaaagcctaaactgcttgcaggcatgatttccttcaatcttctcaatgggttggtcaagtatttatttttgtgcccattttactgatgaagaactgaggcttagaagaaactcagttagagacacatggcaagtatttgaatgggcttagggtttgaacccacattctccccagtttgtgctgcaccctagaggtctcccatctgccaagggctttatcaaatgcattccttgtcccatggatgagatcaggccaggcgcggtggctcacacctgtaatctcaacactgtggaaggccgaggcaggtggatcacctgaagtcaggagttcgagaccagcctggccaccatggtaaaaccctgtctctactaaaaatacaaaaattagtcaaatgtggtggcaagcgcctgtagccccagctactcagtaggttgaggctggagaaccgcttgaacccgagaggcggaggttgcagcgagctgagattgagccactgcacctcagcctggacgagagagcgagactccgtctcaaaaaataaatacataaataaataactagagagatcagaaaattggggtggattgcccaaggtcaggaaatgagctgacctgcttgaagaaacaatccattctggatccaaagaggaggcactgggcatttttttacttttactgaaaaggtcgtattggaggcagccccagtgacaccttttgacaatttcagaaagttccacctgcagtttggaggcaaagctgaagccaaggcctacatcgtcccagcccctctctccacctccagctcaaacaccagctggcccttagctcttggaacattagtctgcagggggaacagatcctggtgcatgaaggaggcatctcccatcctagacttgaccactccccagtgcagctgcttctcgttgtttcagagattctgagaaatatgttaaataggctaagggagacatacaaagtggacagcagactccaaaaggttaatatcttccttttcagatggttcccacagttgccatggatatctcctacaggaggctttgcaagttccacatgaaggggctgaaattaataaactcctttgaactcagaggaaacaaaccaggtggggctaaaaatgctgcagcctgtttgtatccatcttggacaggggggcctagaagagcaggtgtgtgtgcaaagggcgtttgggtgtttatctgtgggtatgtgtgcgtttcaaccacacatatgcgactgtatgtgtgcctttggtttgtctgtgtatacacatgaaagagggtcagaaaaggactagactgtctgcatatcccaaagggcaaagatttatttgatgatagtttccccaactaggcggcaatatattcaaggtcaagggctgttttttatttgtctctgcaatcccattagcacctagcctggtgccttgtggatgttcagcaactgtctattgaacagtttcatctgttcatttaacaaataattttgagggcctggcactgtgctacgcacagaggttattaccacagtgactaagacagagattctttcttcatggagcttaggagcatgagacaggtggacgaatgggctgaaggatgaattctcaaatgaaaagtcatataagtacctttcctgtggttcatgtgtgtaaacgtgtgcacgtgtgtatgtatgtgcacacaggtatttataaagagacaaaagaattacttgaaaaatgaagtgccagtgaggaacagagtccatgtataaaaaataaagaacgtgggccgggtgcattggctcatgcctataatcccagcactttgggaggctgaggtgggtggatcatctgaggtcaggagttcgaaaccagcctggccaacatggtgaaacctcgcctctactaaaaatacaaaaattaaccaggcacggtggcaggcacctgcaatcccagctactcgggaggctgaagtgaaagaatcacttgaacctgggagacagaggttgcagtgagcagagatcgcaccactgcactccagcctgggcgacagagcaagactgtgcctcaaaacaaaacaaaacgaaacaaaaaatgaagaacatggacaccggcgtcaacacgtcctgcctctgttgctaatcagctatacctccttagtcaatcagagccacagtttactcacattgaatatttttggcacacctaccatgtgtgaggtacgttccccgccctgggacatagcaaggagtagagcagacatcaatccccaccgtcattgagtaatgattctaaaactcagtgagtgccagaatggcaagaggctccaaggtggcccagggaagcagggaaggtgtctgaaggaagtgactcttccaccgagacatgaaggatgtataagaatcggttaagtgacaggtagaggggaaagagtcccaggcagaaaaaatagtgtgcacagaggtcttgaggcaagagcaattatggcacgtttgaaaagctggaggatattgaatacagcagcagcactgtgtgtaaaggggaggaaaggctgtatgaatgggtgtacatatgtgtccatgcatgtgtgtgtgtgtgactcagtatgagtgtgtctctgtatgtgtttccaggcatgtgattatgagtgtgtatctgaataagtgtgtgcatgtgtgtctcggtatgtatgtacatgtgtggtatgtgtgtctgagtgtgtctgtgtttttaagcatagtgcgagtgtgtgtgtctccatgtatgtgagtctgtgtgtgcatgtgttcccatgcaagtgtgtgcaagactgaatggctgtctgtgtgcatgtgtgtctaagcatgtgtttatgcatgtgtctgaatgagtgtgtgagtttgtgtgtgtgtgtgtgtccaggcatatgagtgtgggtgagtacacatccttacaaagaagtttgcagatactacgaccagaaagccacagataaaggaataagacttcctatgggagttctgtaaccacagagcaaaatcaatattctaaccgaattgcttttatagataatgtattatgtgagaaaagttttaattaaagtgtggcctctaagaaggttgctccaagactcacagatttcactgttctgctcagacagagctcagggcaggtggggagcaagctgggtattatccaacaggcagccctcccattccttgtcctcctctgtggctgccattttcacctgccttgttataaattcattaaaaaaaaaaaaaaacggccatgcacgatggctcatgcctgtaatcctagcactttgggaggtcgaggggggtggatcacttgaggtcaggagttcaagaccagcctggccaacatggtgaaacctcgtctctactaaaaatacaaaaattaactgagtgtggtggcgggtgcctgtaatcccagctactcaggaggctgaggcaggagaactgcttgaacctgggaggtggaggttgcagtgagccaagatcacaccattgcactccagcctgggcgacagatacagactctgtataaaaaaaaaaaaaaaaaaaaaaaaaaagcatatttaggaaatgctgttcattaatgttccagaaaactatgctaacatattgatagtcaaagaaatgcagacgaaaacaaatcatattctttgcataaaagagaaaaaaatagaatttaaaataataatatttgcttgcagtaagggtacagtataccaggtacgtttgtgataggagtgtagatcggttcatattttctgaaggatatttgaaccatagtatctgaaactttaaactagacatacctttggattcagcatttctgcttctaggaatttagccaaagaaaataatcactcaaatggggcagattaagtgtaaaaagttgctcatcaaagcatcatgaagatgcaactcttgttatgatggtgtgatctttcccataattggcctctaaaggctgagaacaaaaggtcataaacattccacattttaagtatagtaaccaccaatatttggccagctttctccctgaaagtttaggtttcaggtagtggtgtgctggtaaatgtttaacaaacagctatggagtggaggtggagatggggggttgtcagatgatacaaatttccatggtgtaaatactcccaccagggctgattctgcgcttccaatgcgtgcttgctgaatgcagagttttgaagagatactaacaattggccctcacgagccaatatgagcaccttcagcatacgatgggatagaggagccacttctgctgaagcaatgctgattccttgcaatgcatgctccacagcacatataagtcagggagggagagtgaagttatcctttggagaggcgcagcgttggtgcagagagattctccctacttccgcttacttccccagaggttctactcctcgttgcaaaatgagggatgcacaaagcaaatagctcactaagttgggaggcatttataagaaggggctgccagactctctctctctgcttgctgaccagtttagtgcttcctgagctaattaagaaggcattgggacacaataatggtgcagactgaccacaaggctgataggagacaaggaccactttctttcaagtcccagctttgcaagtggaatggaagatggatgaggggaaagggcactctaaatagcgtgtgaaattgacattgtccaatgatcaagactgaatcttcagaaccaagctcaaacagagacttttaatactaggatgtatctgtctgaaccacactagtgatttccttgaggaagcctgctaggtaacaggataggaaaaatttgaaagggcagagttaacagcagctattggaaaagaatacatttttctggttttacctcaatgacttgaggcttgtcaatcaaattggtcacacttttgaaataacctaagtatccatcaagcaggaattcagtataatacagcacatccatttattcaaacagcatgcagatattcaaagatgttaatacccattgtgtgtgtgtgtgtgtgtgtgtgtgtgtgtgtgtgtgttatctgtatcttaattcaagtaccaccaaataatcactgatatatgcttctttgaggtttttaaaacttaaattttatagtctcatttttaactagacagttaataactctgtgaattaaaaacatctcttttccttgggtctactctgatatagtcaacactggagaattcaaaatcacagtatagtctttctaccatagttgctaccaagaaaagatgactgcaataaatgaaaagatgaccacaataaataggtgagtgggaataaaaagtgatttacaaataattatgtacaatatgaccttgcttttgtaaaagaataaaaaagtgtataaccatatatataggaaaacatctggaaatgtacacactaaaatgtcaagagtagttgctctgggtggggtatggtatatagacctttatttaatcatttgctcaacttgccattctttggttaatacttattaagttctcactgtgtatcagagacactgctagccacccatacttccctgttttatctagtattttacagatcttttgccttataattaacatgcatcaaaaaaatcaggacaggaaaagagagagcttttattttgctgaaaaaacgaagtactcagcccacagtacttagaactcaaagggtacttagtaatggtggccatgattgtatcattctgtgaatcttggctcttcctctgctatagcttctagaacaatcgttgtaacaacaacagtgataggcggttccaagatggctgaataggaacagctccagtctacagctcccatcacgagcgacgcagaagatgggtgatttctgcatttccaactgaggtactgggttcatctcacaggagagtgtcggacagtgggtgcaggacagcgggtgcagcgcaccgagcgtgagcagaagcagggtgaggcatcgcctcacgtgggaagtgcaaggggtcagggaattccctttcctagccaagcaaagctgtgacagatggcacctggaaaattgggtcactcgcaccataatactgtgcttttccaatggtcttagcaaacggcacaccaggagattatagcccgtgcctggctcggagggtcctaagcccacggagccctgctcactgctagcacagcagtctgagatcgaactgcaaggcagcagtgaggctggggtaggggcacccaccattgctgaggcttgagtaggtaaacaaagcagccaggaagctcaaactgggtggagcccaccgcagctcaaggaagcctgcctgcctctgtagactcctctgggggcagggcatagccaaacaaaaggcagcagaaacctctgcagacttaaatgtccctgtctgacagctttgaagagagtagtggttctcccagcacggagtttgagatctgagaacggacagactgcctcctcaagtgggtccctgacccccgagtagcctaactgggaggcaccccccagtaggggcagactgacacctcacacggccgggtacccctctgagacgaaacttccagaggaacgatcaggcagcaacatttgctgttcagcaatattcgctgttctgcagcctccgctgctgatacccatgcaaacagggtgtggagtggacttccagcaaactccaacagacctgcagctgagggtcctgactgttagaaggaaaactaacaaacagaaaggacatccacaccaaaaccccatctgtacgtcaccatcatcaaagaccaaaggtagataaaaccgcaaagatggggaaaaaacagagcagaaaagctgaaaattctaaaaatcagagcgcctctcctcctccaaaggaatgcagctcctcaccagcaacggaacaaagctggtgttttgttttgcatgactttgatgagctgagagaagaaggcttcagatgatcaaacttctcccagctaaggaggaagtttgaacccatggcaaagaagttaaaaaccttgaaaaaagattagacaaatcgctaactagaataaccaatgcagagaagtccttaaaggacctgatggagctgaaaactatggcatgagaactacgtgacaaatgcacaagcttcagtagccaattcaatcaactggaagaaagggtatcagtgatggaagatcaaatgaatgaaatgaagtgagaagagaagtttagagaaaaaagaatgaaaagaaacgaacgaagcctccaagaaatatgggactatgtgaaaagaccaaatctacgtctgattggtgtacctgaaagtgacggggagaatggaaccaagttggaaaacactctgcaggatatcatccaggagaacttccccaacctaacaaggcaggccaacatttaaattcaggaaatacagggaacgccacaaagatactccttgagaagagcaactccaagacacataattgtcagattcaccaaagttgaaatgaaggaaaaaatgttaagggcagccagagagaaaggtcaggttacccacaaagggaagcccatcacactaacagctgatctctcggcagaaactctacaagccagaagagagtgggggccaatattcaacattcttaaagaaaagaattttcaacccagaatttcatatccagccaaactaagcttcataagtgaaggagaagtaaaatactttacagacaagcaactgctgagagattttgtcaccacctggcctgccctaaaagagctcctgaaggaagcactaaacatggaaaggaataaccagtaccagccatggcaaaaacatgcccaaattgtaaagaccatcgaggctaggaagaaactgcatcaactaacgagcaaaataaccagctaacatcataacgacaggatcaaattcacacataacaatattaaccttaaatgtaaatgggctaaatcctccaattaaaagactcagactggcaaattggataaagagtcaagacccatcagtgtgctgtattcagaaacccatctcacatgcagagacacacataggctcaaaataaagggatggaggaagatctaccaagcaaatggaaaacaaaaaaaggcaggggttgcaatcctagtctctggtaaaatggactttaaaccaacaaagatcaaaggagacaaagaaggccattacataatggtaaagggatcaattcaacaagaagagctaactatcctaaatatatatgcatccaatacaggagcacccagattcataaagcaagtccttagagacctacaaagagacttagactcccacacaataataatgggagactttaacaccccactgtcaacattagacagatcaatgagacagaaaattaacaaggatatccaggaattgaactcagctctgcaccaagtggacctaatagacatctacagaactctccaccccaaatcaacagaatataccttcttctcagcaccacatcacacttattccaaaattgaccacatagttggaagtaaagcactcctcagcaaatgtaaaacaccaaaaattataacaaactgtctctcagaccacagtgcaatcaaactagaactcaggattaagaaactcactcaaaaccgctcaactacatggaaactgaacaacctgctcctgaacgactgctgggtacataacaaaatgaagtcagaaataaagatgttctttgaaaccaacgagaacaaagacacaacataccagaatctctgggacacattcaaagcagtgtgtagagggaaatttatagcacttaatgcccacaggagaaagcaggaaagatctaaaattgacaccctaacatcacaattaaaagaactagagaagcaagagcaaacgcattcaaaagctagcagaaggcaagaaattactaagatcagaacagaactgaaggagacagagacacaaaaaacccttcaaaaaatcaatgaatccaggagctggttttttgaaaagatcaacaaaattggtagaccactagcaagactaataaagaaaagagagaagaatcaaatagatgcaataaaaaatgataaaggggatatcaccagcgatcccacagaaatacaaactaccatcagagaatactataaacacctctatgcaaataaactagaaaatctaaaagacatgaataaattccttgacacatacaccctcccaagactaaaccaggaagaagttgaatctctgaatagaccaataacaggctctgaaattgaggcaataattaatagcctaccaaccaaaaaaagtccaggaccagacggattcacagccgaattctaccagaggtacaaggaggagctggtaccattccttctgaaactattccaatcaatagaaaaggagagattcctccctaactcattttatgggaccagcatcatcctgataccaaagcctggcaaagacacaacaaaaaaagagaattttagaccaatatccctgatgaacatcgatgcaaaaatcctcaataaaatactggcaaactgaatccagcagcacatcaaaaagcttatccaccatgatcaagtgggtttcatccctgggatgcaaagctggttcaacatacaaaaatcaataaacgtaatccagcatgtaaacagaaccaaagacaaaaaccacacgattatctcaatagatgcaggaaaggcctttaacaaaattcaacagcccttcatgctaaaaactctcaataaattaggcattgatgggacgtatctcaaaataataagagctatttatgaaaaacccacagccaatatcatactgaatgggcaaaacctggaagtattccctttgaaaactggcacaagacagggacgccctctctcaccactcctattcaacatagtgttggaagttctggccagggcaatcaggcaggagaaagaaataaagggtattcaattaggaaaagaggaagtcaaattgtccctgtttgcagatgacatgattgtatatctagaaaaccccatcgtctcagcccaaaatctctttaagctgataagcaacttcagcaaagtctcaggatacaaaatcaatgtgcaaaaatcacaagcattcttatacaccaataacagacaaacagagagccaaatcatgagtgaactcccattcacagtggcttcaaagagaataaaatacctaggaatccaacttacaagggacgtgaaggacctcttcaaggagaactacaaaccactgctcaacaaaataaaagaggatacaaacaaatggaagaaattccatgctcatggataggaagaatcaataatgtgaaaatggccatactgcccaaggtaatttatagattcagtgccatccccatcaagctaccaatgactttcttcacagaattggaaaaaactactttaaagttcatatggaaccaaaaaagagcctgcattgccaagtcaatcctaagccaaaagaacaaagctggaggcatcacactactgacttcaaattatactacaaggctacagtaaccaaaacagcatggtactggtaccaaaacagaaatatagacaaatggaacagaatggagccctcagaaacaataccacacatctacaaccatctgctctttgacaaacctgacaaaaacaagaaatggggaaaggattccctatttaataaatggtcctgggaaaactggctagccatatgtagaaagctgaaactggatcccttccttacaccttatacaaaaattaatttgagatggattaaagacttaaatgttagacctaaaaccataaaaaccctagaagaaaacctaggcattaccattcaggacacaggcatgggcaaggacttcatgtctaaaacaccaaaagcaatggcaacaaaaggcaaaattgacaaatgggatctaattaaactgaagagcttctgcacagcaaaagaaactaccatcagagtgaacaggcaacctacagaatgggagaaaatttttgcaatctactcatctgacaaagggctaatatccagaatctacaacgaactcaaacacatttacaagacaaaaacaaacaaccccatcaaaaagtgggtgaaggacatgaacagacacttctcaaaagaagacatttatgtgccaacagacacatgaaaaaatgctcatcttcactggccatcagagaaatgcaaatcaaaaccacaatgagataccatctcacaccagttagaatggcaatcagtaaaatgtcaggaaacaacaggtgctggagaggatgtggagaaataggaacacttttacacagttggtgggactgtaaactagttcaaccattgtggaagacagtgtggcgattcctcagggatctagaactagaaataccttttgacccagccatcccattactgggtatatacccaaaggattacaaatcatgctgctataaagacacatgcacacatatgtttgttgtggcactattcacgatagcaaagacttggaaccaacccaaatgtctgtcaatgatagactggattaagaaaatgtgacacatatatacacaccatggaatactatgcagccataaaaaaggatgagttcatgtccttagtagggacatggatgaagctggaaaccatcattctcagcaaactatcgcaaggacaaaaaccaaacaccgcatgttgtctctcacaggtgggaattgaacaatgagaacacttggacacaggaaggggagcatcacacactggggcctgtcgtggggtggggggatgggggagggatagcattaggagatacaccgaatgtaaatgacgagttaatgggtgcagcacaccaacatggcacatgtatacatatgtaacaaacctgcatgttgtgcacatgtaccctagaacttaaagtataataaaaaatatttaagaaaaaaacaacagtgatgatagcctgtattgatatagtatttgttacatgccagggcggggttctgaatactgatttggctcaaaataactctatgaggtaactatcattcccattttacacatcaggaaactggaggcagaaatattgttcctgcaataacaggtctcctccctccataagtgcaacctggcctgagacttggggcactgtcttcaccccaccccatccctgaaactgctctgataggaacaatagacctatacacacaggcacacacccagaaatagattgggatggttctggcctgggttattgtgggtgactcagacggtcagagaaaaaggtaatgtaacgcagacaaatgtgagataataagtctgaagccaatgaaacaaaggagagggagagcacatactaaataaaaagtcatgagtccctgcagcctggaaagggatttagagtttactgttaaaaaaaaacaaaaaaaaacaaaaaaaacaaaaaaaaaacaacaacaacaaaaagaaaaccctccttgaaattgtcagcactttgtactatcagagtacacttgggaatcgaggggctcctgtgtccatgcctgtggcatctttatccactgatggaggccaggaaggagggggtctggtcattccatcctgctggggtcaggctgggagcaggagagctgtttctgagcctcggtgtgtccacggtggatccatgcttattctgggtcccaaggaagaggctgggctgaaacaacaggaatgtgtccctgtagacagcccagcaagaagtggtgtagggtggggcagaagatgagttccaggatctcagagtaaggatttgcatggaggctggaaaatctggaagaaaggcaaagtacacgcggattgcagatggtcggggtgaatgggaaggcttcagccaaacaggatagatggcagccagaaaggaagtgtactgggggcttgaatggtctagaaaagcctgctagaagatggggcaaaaaaggtcagataatgcaaatatccagggacaaagccctctgggggaggaggagaggttttgagcatggagtgatggggatggtttaaaccaggccaggagcctttttttttttttatttctaattttaatttttagagtcagggtctcactttttttgcccaggctggagtgcagtggtaagatcatggctcactgcatccttgctctccttaagcaatcctcccacctcagcctcctgagtagccaagaccacaggtgtgagccacagcacccagctaaattttttatttttagtagagatagggtctcattatgctgcccaggctgggcttgaactcccaggctcaggcgatcctcctgccttggcctcccaaagtgctgggattatggacatgagccactgcatttggctcctgggggcatttttgtatccaaagaacacaaacagatgatattaacaaaagcaaaaccaactaattcagtcttcatacttataaggtcaatattattatccctgatttaaagaggaagaaactgaagcacagagggtttgggtaacttaacctcaggtcacccaaccagctagtgacagagctagaattcaaaccgaggtcacctggctgcattgcatgtgctcttgacaaagattctcaacttgatctgactgtagtcaggcttctcagagacctctgtccgaacaggtcctgaccttggtctttgtccttattccaggcccacttttagcaagaatcctgttgagtcagtttattgaaaatctcccaccctcagtatcttatcaccctggtccaccttcaaaagaaaccctgttaggtcagcttagtaaagaattaccctatttcttagtgagcttccacccaccaacctccaccccacatcccactccttgcctgtaaattgcctgttttctgattttatttggagtgggactcagtatttctcccctacttcaaaaccccgttgtagtagcttcccttgaatagtctttcttgaaagtctaaagacatctttagcagatgtcattaataatttgtttttaatattctttttttttcagctcactgtagcttcaacctctcgagctcaagggatcctcctgcctcagccttctgagtagctgggattacaggcttgcgccaccatgcccaactaatttttttatttttagtagagacagggtctcactatgttgcctaggctggtctccaactcctgggctcaagtgatcctcccacctcggcctcccaaagtgattggattacagatgcgagccacagtgcctagcctgtttttaatattcttttttttttttttttttttttttgagatggagtttttcccttttgctgcccaggctggagcgcaatggcgtgatttcggctcactgcaacctccgcctcccgggttcaagcgattctcctgcctcagcctcctgagtagctgggattacaggcacccccccatcatgcccagctaattttgtatttttagtagagactgggtttctccatgttgttcgggctggtctccaactcctgacatgagatgatccatccgcctcagcctcccaaagtgctgggattacaggcgtgagccactgtgcccagacctgtttttaatattcttaaccactacacatactcctctaatgttagacaaaaataaaactcataagaaggactccagtaaatgccataagtcattagggccaagcagcattgccctggatcatttctaattgggtatcaaaataaggcaagaaggggagagaacaattctctgttttgtcctacaccatagagtagcttgggcttacaatggcaaccatcaaagctagagggattctttggagcccaggctgggggcagagccaccagcagaagagagctctatggcaggaatgactagtgcctagaagagtagctcagggatgcctgaaagctaaaggagagaactcattcttgagaaaccctggaagaaccactgagaccccagctgcctgcagagacatttgcacgaggccaagactactgatgggagcaggtggggccagcagatgctggggtattccgattgcccagcctggtgagcttgcaagaaattgtaaatatttccctctttttcgtgactcgttacagagaggcgagatacaattttcttggagtgggggagcagagttgaacaagtccagtttactccgatttcaagaatgtttctattaggctaaagaagattcaggatgcttcgaggagggaaacgatttcaaggtgaccttgtggaaggagccggcactatgaaatgtttttgatcgagtggaacaagataagctgttcatgttgcggaagggttcaaagccctggacaccagctgaaataagaaaattcaatttctggcataagattgtgttttttctgccttctagaagaatgtacacatctgcccctcttctctccctaatgaaagcatcgtgttcctctgcagtcgttccgacacaaacggggtcgtaaaggcaggtttgcatggcataggtgataccactggcaggtactcagacacagagatggctgtttcagtccagaggcttctaggaaacttcacacatggccagggctgggaccagggagcgacccagggctattttgatatcattgtgttttcttttgttctcccacaaaagactcctccatgtttatcgaaaacattgctgtccagtagaactttctgcattcatggaaatgttctatgtctgtaatattcagtagggcatctccaaccacatgtgactcctgagtacttgaaatgtggccagtgtgacaaagagattcaatttttaattttatttcattttaattaatttaaatagcctcgggtggccagcagctatctcattggatagcacagtgctgaaagactcagtggaaagggcatgatcctcacgcccacctagattgggcttgaattctgcctctatcatttgctagctgtgtgaccttgggcaggtttcttaacctctctgaccctctctctcatcctcacctgaaaaatggggatgatgatatcagtgttgcaggattttggtggaaatgagttgcatgcacagaatacacagcaggccatgtgcaagtagtaaatcttagctgtagttattaattcataagtatgtctgtggcttcacaattgacttgggatttctcagttgtggacacgaactcttgctaacaatgacggggcaaagtggaggtaaggaatgaggggtcttctgtgttggaggcaatggggatcctgcagggctcaaccagcaggatgagctcagactcagggccccccaacaggcagaaggtggacttgaggcattgttgggcgagcaggaccagccagctgcccttccccgcccccaccagccgggcctccctgattaccgccaaggtgagaggaggcccctctcctaagagggcaaggatgaggagaagcagacagggagggagggagaggagagcaaagatgtgagttcattgcaaactcaggaaagactgaggacagagagacagggaccaagaaggaaacagatggaagcagggacaacagaaagcaaaggagcagacaggaggccatgcacagagccaggggcagggaaccgcaagggtgaggcgggcagagacacacaggaagccagggacacagacacagagaccaagacacagagacagagacacagagaagacacagagacagagatatggacatggagacatagagactgagacatggagacagagacatagatagacggagacacagaaacacagactgagataaagggacagagacacaaagatatagagatggagacacagagacagagacacagacatggagatatagagacaggaagctagagacacagagagacagagacacagagacagaaacagagggagagagacacgggaacatagacacatgaaaatagagatacagagagacagaggcagagacatggagacagacacagaaatacagaggcaggaagacagagacacagagagatagagacacagacagagacacaggaacacagagacatgaagacagagacaaagagacagaaagacacagagataaacacggagagatggaaacacagagacagaagacagagatagaaatgcaggaacatgaagacagagacagagagatacagagaaagagacagagacacagagacagaaatggaaagagacaccgagatgcagagatagagagactgatacagagagagagatgcagagagtcagagacagagagacaagcaaaaagaataagtgggatgggggacagggcaagacagagcaagaaacataagtcacacacacgcacgcacgcacacacacggacagagatgggaagacaggctgagagagacaaagcaaaacatagacagggaaataaaaagatgagagaagagtgagttaggaggaggcagggaggaaaagctggagaaggcatggatggagtggcacagggggaccgcagagacccacagcaagacggaaatacatttcaaaaaagaaaagcaagaaatggaggggcatagatgtggctgagtgccaaagggagactggttggcaggggcggggctgggagggaggggctgggtgggcccgcagcagcggggcagaagcagctccacctaggctgggggcttgcatggtgtatccccgtgaggtttcccaccgagccctctttgttcctccacctcctcctcaccatcaggcagagggcttgggaacttgggggcagccaaggattccagagcccccctcgcccgcgctccttccctctaactcgggagtcgttaatcttggagggcaggttggtcttttattagctatctccaagggtcagcttagaagtatctgagaagatactggttcagaatgtcatttgtcatctggaggcctgacgggtggccgcatcgactcagccccctcctgtcctccctggaatttaggaaagcgaaagctgctcttaacctttcccttaaatggagctttaattcctctctccttctctgtttgctcatcagggcagcgctatgggaacaataggaagccacaggcaggaaggggggattgctcctcccagggaaaggtggggtgtccctgctccttgcaatgcctccctccccacttcccagccccccacatcagctgttctcaagcttggttgtatgtgggactctcctaggaagctaaaaaaatggctgagggggccgggcacagtggctcatgcctgtaatcccagcgctttgggaggccgaggcaggtggatcacaaggtcaggagttccagaccagcctgaccaagatggtgaaaccccatctttactaaaaatacaaaaattagcagagtgtggtggccggcgcctgtaatcccatctactggggaggctgaggcagggaattgcttgaacccggagggcagagggtgcagtgagctgagatcatgccactgcaccccagcctgggtgacagagcgagactctctcaaaaacaaacaaaaaaagatgctgaggcctgggctcacccacagaggttgaaatttcattgctctgggctgaagttcagacattgcagcgttcaaacctgtcctcaggtgatagtaatgagcagctaagacgaaggtctgctgagctagatgatcccctacctgccttttcatcatcatccagtctcaaaccaggcaacacctcctctgagaggccttccctagtaaccttcccttgaaacaatgcctgatcacaatcccccattcatctgctgccaagcattagcagccatctaaacagtgattaagagcctggcctctcaagccagcacatgtgggttccgatccccaagccactcctccatagctaggagatctcgggccagtcacttattctctgtgcccccaattcccccttctgtaaactgggaatgataacgctttcaaggattctagtgtggattcaaggagccaacaaaggcaacgtgcatgggagagtgcctggcacagagtgagccctatattagtgtttgcaactgttattaccttgctttttatctcctcttgtttagctcttcctgcaagcttccttatggactaggccatgattatcatcttcatcgtccccattttacagatgagaacactgaggcatgagagagtaagaaacttgggcaaggggctaggtttcaccatgactgtttgactgtggccctccagagctagtaagggtagaagcctgtgcaagctggtaagaggctgggcagttggcctgttttaccctggcctgtagggcttgagctttcgtggacatcagcacagagaaagaggtgttccagttggaggaagcagcttgttcagccataggaagcagcctggggcttctgggaaaggtactggctctgggtggtgttgggagtgggaagaagttggggggagtggaggcagggctggcaccaagagctctggagggaatgtcaaagatggagagttgtgttgaggttttggttctgcgtccacatggagatggagaatgactggaacgcaggtcccctaacttccggtccttgggtcttgcccatggaccctggtctagcgcttcgaaatcgtagacaattgggatccgtgtctgaagttggttgggtgagatagttctggggtcaaacccctctaatctgggctgcaaactcaacacctccactctccagctgcatggccttgggtaaggtccatgacctgtgtctgccttggtttcctctcctgtaaatggaggtgaggaacctccctcagaggatgtggtgaggactgactgagacgaggcatgaaaagcatggagcaccctgcccgcctgagtaaacaaaatactcaccattgctgacactgacaaccatctcctgggtgggaaggatgaggagaaaaatagaacagctggaaatgattatgattgggatgtggcacaacaaaggaaggaaggaagagaggaaggaaggaggggagggaggggggaggaaaggaagaaaggaaaggaaggacggatggtgggaggcaggaaggatgaaaggagggagggagggaggaagggagggaggatggaagtgagggaggaaggagagggaaagggagggaggcagggacggagggaggaaagaaaaaaaggaaagaaaggaaggagggggaaagggagggagggaaggaaggaaggaaaaaggaaggaaggaaggaaggatggaaggaaggaaggctggctgagaggttttcacagatgaatgattttcagtggtaaaaccagggaagtcctaggcaaatagagatgagttagttgctctaaggaaaggtctaaagcagtacactttaattcttcaagcgcaaagtaagtcaaaagaaaagcaaggaaattgagtcaagctacagcacaaccaattgaggttagatctcatacaggacttcctggctactgaacaacaggcacgggtgggcgcgccctttagcaactgggaagaaagctcagagttcaggaggcaactaggagaaacggcgaagcgcctctctggggatggaaggtccgtgttggctgctggttgccctctgtgaccgggtcagctctcctgtgacccatcgtcctcggcagagccagcagtacatttccaaatgccagacatcagaggctcaggaaagatgctcagcccgattccgacagagcaggttaggggcaggcatatgcttggtggcacgcagcctaatctcagagaaagtgttctgatagaaagattcatgatagccatccgggctgcagacaccaggccttaacttccaattccaagagccctgcggtgcacgcctcttacccggcggctggcattgcagcaggtctcaggccaggcagatttacagcatattatcagcaaatgaatgtcacagctggtctttgtgcttcagaggaaaggaaaagaaaggaggacagttcagaaaaaaaggaggcttcaggatccagatgattctgaatccctttctaaccttctgtgtagacaggctggagctacagggtggggtgggcataagaaccctgcagccattgtctacagaaggcactgaagtctgcaggggtgggtgagcgcaatgcagcaaaccagggtgtttccataacaaaggggagcatgctggcctccccactccagcagaaagggctgggaggagagaacagtatctcaactctgcagctcaaacacacttcctcatctgttggagcacggtggtccaatgtgtctctgacgcatggcctcctggggaccacaagggggtaaaggaggtgactttagggtagggactcccaggatcacagcctcttctctaattccaggcaggaggacagggccataaaaaaacacaagttctgttttacttttctccaactggctataatgaaaaggttcaaatattcagaaaagttgtaaaagtaatgcaataaatagcacctagattcaatggctaatatttcgttagcaatgctctatcatacctgtttgatgtatgtgtgtatattctttctgcactatgtgaagttgcagtcatcgtgattcattacccctaaatacttctgtcttctaggaaaaaggcattctcccttctacaaccacaacaccaattatcacacctaagaaaatgaaaattctatatcatctaatatccaaattcaaatttcctcatttgtcccaagaatgcatttaacacattttcaaaaatgcattcttgtgacacttcgatcaagatccatgcactatatatttactatgtcgttgtagcatcttttaatctggacccgccacaaccccctctacatttttattacactgattttatgtagagtccagttgtcttgcagaatgtcccacattctggatttgccagattgctttcccatgttgtcgtttcacttttttctctgtctcacatattttctgtgaactggaatttgagcctcgatatgatcgaggttcgattctagttaatttcgtgaattagatttatgctttaccttttcagcaaggaacctttttagagggcactctgcacttcatatggcattacattactacattcagtggtaaataacataagggtgtcacgctatcaatgaagaaaagtgtgtcacttggttaaggcggtgacagctggtcacctattgtgaagacacactttaccctcctttactttacaaagatagccatgattgaggttggaactaggcaacacctcttttctccaccaatctttctccaaatggttatagcatctattgctaacacctgcctgaaatacttattaaactgcaagtttaaaaatgatacttttcaccactgataggtgtatatattcacaagaaaggaaatcagcatatcaaagagatagccccactcccatgttggttggagctgttcacaatagacaagatttggaagcaacctaagtgttcatcaacagatgaattgttgaagaaaatgtgctacatatttacaatggagtactacgcagccataaaaaagaatgagatcctgtcatttgcaacaacatggatggaactggaggacattatgttaagtgaaatacactaggcacagaaagacaaactttgcatgtttccacccatttctgggtgctaaacattaaaacaattgaactcatgaagacagaggagaagaatagttaccacaggctgggaagggtagtggcagagggtggggatgattaataggtataaaaatatagttaaataaaatgagtaagacttagtatttgatggcacaaccgggtgattacagtaatttattatacattaaaacttttaaaaataactaaaagggtctaattggaatgtttgtaacatagagaaatgacaaatgcttgaggtgatggataccccatttaccctgatgtgattattacacattgtatgcctgtatcaaaatacattaggtaccccataaatatatacactactatgtacacacaaaaactaaaaattaaaaaatgatactttttctgtctttccttctgtttctccttctgtattagctggtataagaattcttggctgggcacggtggctcacacctgtaatcccagcactttgggaagccgaggagggcagatcacgaggtcaggagttcgtgaccagtctggccaacatggtgaaaccccgtctctactaaacatacaaaaaaaaaattagccgggcatggtggcatgcatctgtaatcccagctactcgggaggctgaggcaggggaattgcttgaaccagggaggtggaggttgcagtgagccgatatcgagccactgcactccagcctgggtgacagagtgagactccgtctcaaaaaaaaaaaaaaaagaattcttaaataagttctttcgttttctttccctcttctttctaaaagtccctataggcttagaaattttagccattcaacatataacagacaacttctgtcatttctcaaactaaaattctcccaaatttggctattgcgagccccacaaacctggatttggggctcttttgacacatttccatcatttttgacacatctttgctttctgaaacaattggatgacccaagctcacttcatacatctctaccacagacccggagtaaatcattcctccaaagaatgaggctcctttcagcagggggtggcatttttaaaccaaaatctgggcttcagatgtgataagcacagattctgctgccagataacatgggtttaaatcttaatccaagtagggcatggtggctcacggctgtaatcccagcactttgggaggctgaggcagcagaatcgattgagcccaggagttcaaaaccagcctgggcagcacagtgagactctattaaaaaaaaaaaaatagccaggtatagtggcacatgcctgtagtcccagttactcaggaggctgaggcatgataattgcttgagcctgggaggccaaggcgcgcggatcacctgaggtcaggagttcagaaccatcctggccaatatggtgaaaccccatctctactaaaaatacaaaaattagccaggcgtggtggcacatgcctgtagtcccagctactcaggaggctgaggcaggagaatcacttgaacctgggagggagaggttgcagtgagctgagattgcaccactgcattccagcctgggcaacagagtgagactttgtctcaaaaaaaaaaaaaaaaaatgtctaattcagccacctactagctgtgtggtctcatgtaaatcacctcacagttctgtatgtcaattttctcatctgtagaatgggggtagtaacaataatatattccactttgttacattgttaaaaggattaactatgttcctctttgtgaagccattcaaacagtacttggcacccagtgagtgctatacagatgtttgttaaatatatatgtggccttacaacttatgaagacgggggagagggtggaaaagaccctcaggcatcctgagacagagacagaaaattctttttaaagatcttattcaacttggatgaacataagtgaaaatatcattatgtttatttttactctctttccatctattaatggcaagtcacactgacatgggaactgatttgacatgtggagtcttgaatcaaaatttccttcctaataatgaaagtaaatttttattcaagtaaaatagagatgcacaacaaagcttccttttaaaataagcgtattttttaaaaaatcaaatgagatgatttttaaaaaatgactaattcctaacagctatgaaatgcaatatgtcaaaaatgaatgatgatggaatgacagcaatcaaggtttgggcaatactctaataaagatgcctgggagggaatccttattcctattgtttggaaagatgtttcattttttaaattaaaataattattttaataagctctggatgcatgtgttataaggtccaccaccatctgagtccttcaaggctgaagatccaataggagagcgcaggagatctccatgagacaacagaaatgaagttgaaaattcaccttaatcatattttccccacctgcctttcagtgaggagatgtgggtggaggaagggctgaaatttccaggagggctgctcctgggagaagatcgtatagccctatgtggggtgctatacatgcccccacatatatttctatatgccttggtcataaatgcttatcccttggattttgcataaatgcaaaaataaataagtgaagaattaaaaaataaatgctcatcttaaacacagcatcggaagccatagaccgtctgcattgcgggttctctatatatagaatgagaattccctttccatccacaatcacctttgacttcttcgtattaaaacctggaccccaaagagcagcaactacaaaatgggattcattgaccagcagttcacagaggtccaaaaacaaacttagttaagagccgagggtaggaagaggcaagaatcaaggatggccatgctcaagcagagagaggcaaaggaaagcaaggatggagtctgtgtgtggtgtttgctgtattgacggacgttcagttttatgctttgacctccagtcaactcatcagccctttcatgagtatctatcacgtgccaaaacccagaggaactcaaaagaaacatcctacagcattacctaatgattccaaccattacatgtgctcttttcactgatagccctggctggaaactgaggttttaatcaggtggcaatttcagggtctttagagaaccatcctatgagaagtcactgcagggtgactatttcttggaatttgtagatcatgaaaatgggagtagtgccctagcctaggctctcccctcctccccttattctttccttcagtcacttattctcatgcagcttcagaagatggaagttctcacaccgccgtgaaaatgatcagctggaacgggaccctctccagagtacatttgagggtacggtagatgtaaagtggtagtgttttctcaaccaaaaattgagacatgcgatctgccaaaaataagtccctgtggggacagagagacaggctatttttaaggtgggactccctccgaaaatccggggtggaagctgatgacaattgtagtggggtgttccctctagtgagttttgcacaagtgccatttagcgtctgtctctgtgcttttctcacatacccaaagcatctgccagcagttgtgtctgcatgtgctttgcaatagacagggaagggagatgcgagcccagaactctttcctgtatgtggaatatagaactcccaggcataaacaagccccatgaagacagaatacgataaggaggttggcagttgcagtgggatgtcctgatttttctctcctctggatccctgccctgaaataatcagaagaaagcttctcaagttgatgtctttatagagtaatacctggagaaattttttaattttaaattttcttaaaatgccaaaataattaaggataatagagtccctgctgtggaataagaaccattcaattagttgaagtacactcctgtcaatcttgtaaacaaccggggatataaaattaaggacagccacaagagaatgaaaactgtgaagtcaggatctgagggtgctgtttctgcaagtgggcattcaacaaacattagttcataaatgaatgaatgaatgaactctacctaagttgcaaattaagagcctacatattttctttatgtcttttacattagatttgtgaagaacaaatctgactgattcagtccagactatgcagtaattcatcttggatcacatgactcactccatccattcagctgtggccacaaggatggattctacagtagaaatagcactctaggatcagggatgggtagggaacttccaaagaaggaaatatggatagagcaggcaccccaaaacttgatctcagccttcagttctttgctaagggcatgacaaggattattcgttcagtgtggctaagggaattatcctggtctggtttgcgtgatcttcggtggctcccatatggttttagtatatgttggaatggttatgttttgcttctgttctaaagccctaagtttgcttctgaattacccataatagtgcagatgcttgctttcttccaatgcattttgttgcaagatttgagctcactctctcgcaaccccttctcctccccttctccctttccctttccctcttgcttcctctctttggttctcctccctgccacccaagtactttgctgccgcacctctgtactgtttctcattagagtctttcctgcagaattaatattcttctgtggaactcagggagggctggttattgtgtttgggtgagaagggttcgttattcttctttgaaatctgagctataaacaggctccctgttgcatagggaaatgtagccatgatactttttgtataactataatgctattacgtattcccccagccctagaaaatgcaatgaatgggcattatggtttaatcactcttttcccagtgttatgtgtcctgcacttatacataggacacttaatataaggttggttatctatacaccatctagtcatgacaatgagaaataggtctgagtctcatgtttacaacagtataacaggttagtaaggtagtactctatcaaatgatgttggatcctcctaagggcacatacagaattgtacttcttcactcttttgatgttagacatgagcatgtgacttgttttgtccagtgaagcatgagcagaaatagaacatatcacttacaaatggaaatgttaccagccaatgtgtgatttttttttccatctactttttacctctaccacgctggcaacactccaaagtagacattccataggcctggatcttggagctaggagaaccttcagtaacttctgatagaccttcctctaagccacagcaatatgggttgtttgttactgcagcaaaacttagcctatcctgactgatatatatatatttatatataatatatatatttttatatatgtaatatatatacttttatatatgtaatatatatattttatatattatatattatatacatataataaaaatatctcacacataaaaaaatttctttcatgaatttatatatctaccatccatctgttcaaatacatattgtgcactttctatgcaaaaggtgtttgaataaaagagaattgattgtaggaagtgatatcaaataggacatgtgagatatatatatatatatatatatatatatatacacacacacacacacacacctatacatatatatacacacatgtatatgtatatacctgtaatatatacctgtaataggattgactatgcgtaaggcacagtgctaagtattttgaatgaattagtttatgagatttttttaattaaaatactttttttgagacagagtctcactctgtggcccaggctgggctggagtgcagtggcacaatcatggttcactggaccttccaggctcaagtggtcctcccacctcagcctttcaagtagttgggaccacaggcatgcaccaccatgcctggctattttttttaaaatgttttatagaatcagggtctaactatatcaccccggatggtctcaaactcctgggctcaaatgatctttcggccttggcctcccaaagtgcccagattacaggcatgagtcactaacccagccttaactttttttttttttaatcataagaaccattttatggtttaggaaaagaaacaaaaaactaagaaaaaacaaaacccgagcctcatagagtttctgtctctcacccagcattgcatagctaataagtcacagatttgggtttcaaaccaggtgtgtctgcctccaaactacttaatcactatgctatattgcctctttccaaacactaagatagttttgtgtttcctcagaaaaccatgagaaagcaaagaaaaataaaaactctgccctttcagatccttgcagccagccaggctctccgggtttggtttgacaggttgtcttcccttcaaaatgaaaagagaggcacatggacagaaataaaggccagctgttcagtggagcgagatacctgtgtgcacgccagcagagccaggcgattatttcaggagccgctggagttggcggctccgttctcgcctccatccaccctggatgcgtaggccagggctgacattacccaaataagggagaatctccccagattgcatgtttgtatacagacttaggaaaatgtgagagattctggttagaacacactgataccatcattaatcaacaaccagggagagaaattgaagggatgaaaaggtaggttcttgtacaagaaaaagatttgtgggaagagattagaaatattgagaaaccagagaatatttttgcaaacgtttttccattcttaaagtttcaaaagttaaccaataaaggcagcccccaaagaactcatgtatttattcattcatttgaaaaattactttctgaatgtttgctgtgtaggtgactgagatgtgaagatagaaacaacattttatggaacaaacacttagataaaacctactatgtatcaggcatgattccaaatgctttacatgtgttcattcattccatactcatttaaaaaattccagagaggtagctatgcattatctccattttgcagaagaggaaactgaggcacagagagttatgtgttatcttgctcaaaatcatgcaacctttgggatttttttttttaaatggagtcttgctctgttgcctaggctggagtacggtggtgcaatcttggctcactgcaacctccacctcttgggttcaagcaattctcctgcctcagcctcccgagcagctgggactacaggtgcgtgccaccacgcctagctaattttttgtatttttagtagagacggggtttcactgtgttagccaggatggtcttgatctcctgacctcgtgacccgctgcctcgccctcccaaagcgctgggattacaagcatgagccacctcgcctggccagcctttgggatttgatccctggtgggtctggcttccacactgtgctgatagcatactacctcacagggtcttggtcttcaagctcgcatgtcagtagagaagagagaaagaaataatcttttttttttaaattttattattattatactttaagttttagggtacatgtgcacaacgtgcaggtttgttacatatgcatacatgtgccatgttggtgtgctgcacccatgaaatcatctttttttagagtgtgaagcctgttttgatggagagatctgaggagaaagaattcagttctacttgaggacttcagggagactcttaaatgcttacatgcatttgttagcctggtgggcaagtggagaaaagggccccttaggtggaaggagtggtttgagcaaatgcagaggcaggagacagcctaggctcctcaggaaagtgctgaggcatggaatgtgcaaaggaggacagcaggagataaagcaaaaaagggtaccaggtcagaggaaggaggtgcgcctcttccaactaggcactgcaggggttgagcgtctgccttctgcaatgctgatgcaccagtggaaaagcatccgctgctttgtagatctctcccagctgtgctgttggaaaggcacccggcagctgagtgcagggctggctgggagggtaggtagcagagctattgagagagggccctttaaaatcagacccctctgagcttgaatctcagctctcagttaccacctgagtggtctcaggcaactgaccaaaccttccagagcctcagctgccaaatgggttgctgcaagggctacatataaaaagtggttattactagatctggatgtcgatgttccacttaagaggatgttactatacagtaggtgaaggtagacacatggcagtactgccctgccatgaacagggttgtttctcccatctcacagtgaaaaggaatttgtttgccctgatttatccatgttaacacacagagcttcctgaaagaccaaatgcaaggtgaagttgatgtgcagtcagcagagccaatcaaattggctgatgtgggaaaccagctcacactctccatctcaatcaagcgctctaatccagagatgttccagctttaaagcacacacaaatcactgtgatcttgttaaaaggcagactctgactcaataggactggggaggagcctgggattctgcatttcccaccatctccccatgctgctattccattgaccgccattggcatagtctggccccaatccgcaagatcactttcatcatcctaagacctaagttatcaagcccaagagtgaaaatgcaacccaatgcctctcattaattggcttattctctcatccttccgttaaatattttctaagcatctactatgttccaggtcctgggaaaatacagatatatacaacataggccctgtactcaatcagcttgcccaccctatgcacatggagaaggaaaagagaaggggactggccatttggggggtactcacttcacatatgacatctcagtgaattctcccaacattctatgaaattgcaaccattcaacccacattagagactaggcaactacagcctgccgagtaaggatagctcagggctggggcgcggtggctcacacctataatcccagcactttgggaggccgaggtgggtggatcacctgaggtcaggagttcaagaccagcctggccaacatggcgaaaccccaactctactaaaaatacgaaaattagccggatgtggtggcacacacctgtaatcccagctactcaggaggctgaggcaggagaatcgcttgaacccaggaggcggaggttccagcgagccaagatcacaccactgcactccagcctgggcaatagccattgttggcattgggatttgaagccacatcttttgattctgagatcactgcctcgtttatacttaactgtaagttgttgattgtgttctctttttatttactttgagcttggctgtgtctctttagttttagagagtgaacttttttccctcataaatttaaatgctgacataaggaggaaaaatcctgctgtaattgaacaaaaggatgtttacaaccttctttgagtcatagagctcctggcacatgaaatttatgactgcaaggaaaggggaaataaaaagaagggggaagaccaagacagatgtaactgtggaaatggtgtgctaatgtatgggttgacattctgacacttgcacattcagttgggtaactttttggaggccatttcaccagctaatgaagatttacttaataaactctcaaacttgccagagctagactctttaaaacaaccctataaattacaaagatggtggcatgttcaagagaccttgcagttgttaaaggatggaatgcagttgccagagttacaaaggtcattgtctaggaatcttgtgcccgtctctggagggctgagggacctttcaaaggactggctccgatgtgtgcaccctatccagataaatgcatacagatgttctttgaacttgatcaactcgcttctcagcatgaatgcaaaattgattgggccaaatcagagctcgtgccagtgaaggctggctgcatacagaaataaaatcagccacctcccatttacttagaagtctctggcttaaaatacattggaggaaaatgtgcgcttcacgttagagcaggagccaaattgcacagcgacaaaattattcccatcatcatgacagcctcagccaatcgtttccttttttaatgtgctgaaaggaggcaagttggcatcattaaaagtatttttttctcaaaaatacatcatgaaatatggagaaactagaaacagaagaagggggcccacgcataaatctaattctgagaccggactatggagattttctgttctggttgcactacgaaggttctaaggaaagaggttgtattttttgcctcccgcctctcttgatggcctgaggttgatgtggatgtagattttttttcctttaattcagctcccgtttttcaagcagtgcccctttcactgaatgattatccccagtaacctttgatcttcactcttccttgatgaaaaactgcaactatatcatgtctttttgatgtggtctttcttaagtactgagtcaaggtgatcattgatcctgcacgccttcatttcctcttcccaaatgagtccagtgttcccttcacccttccttctgtcttttattacctaacgaagttctagaagccaagccaggatgctctgatgtgaaaactgcctaaaagggaaaggttaaccctgaagccagtgctcagccagcctgtctgagagatccctgttcctgagccataaagcgatgcttcttcatacccatttttgtccttcagcttctttctgtggagaaaaaaattttttctctaattcagacccagcaaattggtgtgctcctaacttagtctcagaaattctgatttccagatgtcttatgccctttaatatctgtttcagattaccaacctcaccactgagaactgaaagcatgtgtttcttcttctgtgctaagttgcattttgttcttttttcaaacctcatccttagaaattagactttgctgtctttggttgtttctagtacacaactgagatttcctttccagcaccgtgacttaatatccctttctggaatattacttacggagagaaggagtaaattcttcaagattttgaatattctataagactatgtccccatttttacttcagaggaaatcggtcaccattgattttaaggatgaaagttgcacagatgaagagggagcatattattcaaatcaaagcccagtaattcagggatgatcaaaggtttcatctcacatgtcaagtcaaataaatgggtagtgttgtctggcacgctgtggtgagaaaattctgaggctgggttcagacaggatgagaaaatgtggtgaaaaagttcagtaatgtccgccatgggtgatacgttaggacatctattcactttttaaaatgctaactcttgcataagaaaatccacagtttttctgatatacctaccagatatattttaaagaagtttcaagaaaaagtcaaaatttccagggcaaactatcaagtggtcttcccctaaagcagacacttctgtcaaaaggttttattacacacgccaactctgattgataaatgattgtcaggacggctgggttaatctccataactgattagtaatgtctaccacagatgaaggcatggacgtggtgctacatgtacccagtattttctctcctggtttagctcaatatgccatttactctgtcttaggaaactaataaagcaatgaagtttttgaaggcatcccacagagtcagggcatgggttaatctctcctctgttagaggagaagcagaaataaactgaatcaagcaaaatgttaacaaccctgcacccaagatttagaacacatactttctcccatcgcatatggaatatttacaaaatttgaccatatattggccataaagcaagtatcaatagaatttgggccacattctaaaaccatataggaaaataaaagtaaaaccccttctatggtttgaatgtttgggtcccctctaaaattcataagttgaaacgtaatcctcaatgtgatcatgttgggaggtgaggcctttaggaaataattaagtcatgagagcagagccctgatgagtggattaaagccataataaatggccaagttcagctccctttgcctctgcgctcttctgccacatgaggaataatattttccccctccagagaatgcaggatttcaggtgtcatcttgagcagaaagaccagacaccaaacttgccagcgccttgatcctggacttcccagcctccagaactgtgagaagtaagtctctgttctttacgaattacacagtctcaggtattctgttatggcagcacaaaatgaactaagacaactccttttaaacaatttgatagctatgtgaaaaactcactatatatttgcagttttaaaaacatgcttctgaataattcatatactatctgacgtaatttatttgtgcgttttttgcctttcctcatatgaatgcaagcttcatgaagtcgaggagctatgttcattgtactacccacagcatatatacagatctaaccttgtttcagtaggggcatgctgaataaatgaatgaatgaatgtcaacacttaagatattctatttatgaagtacttgaagggaaatgtgtaaccttaagtagatatattagccaggaataaagatacaatatgatttaaacatttaccttgggatattaaaaaataaacagtaaattgaaaaaaagaagagtcttttaaatgagcacagtttagtggaacgtaaataacaggaataagaagagaacaaaacaattatcagggccatttggtattttttttggcaaaatctataaattttcaaggaacaaataatcctatttcttataaaacatttttaaaagaatagaaaaagaagaatggaggagttgattttgtaataaaatatagcctttatatcaaagacaggcaagaaaagttatgtcaatctcatttatagatttatgtgcaaaagttttaaacaaaatattggtaaacaaaaatctagcagtgtgaatagaaacaaacagataaccataaccaaatagagtttgttctaggaatgtacagacagtataacattagaaaatctattaatgtaagttattatgtaccagattcaagttgaaaaataaccatcttcatgtagacagaaaaaacattcagtaaaatttcacattcattcatgtgttaaaagaaaaatgttagcaaactaggaatagtaggagaaattcttaacatttgaagcaaatttgcacttgatatgactgtctatatgtgaaaatcaagactatctagggcaaactatcattttttaaaaaaaacattatgaatacaaagtcaaataaaattagcatatttgaacactatcaacaataagttagaaaacatcattttaatgtcttattcataatagcaaacagaaaataagcttttataggataaatgtattgaaagacctgtcgttatagggacaaatataacatttaattaaaggatagaaatgaagatcatttggagaggaacaccaggttcatggaaaaaagcactatgataaagatggaaatgctccagattgatctatacaaccaatacttcaatcaaaattcaagcagatcatttttcataacacttgacaagcagacccgaaaattcacaaagacatgttgaagccaagaacagccaaaacaattttgaataagaagaacaaagatgaaacacctgtaagatgttaagactggttataaaacttaaataaaagagtgtggatctggtgttgagagagactattagaacaatgttaaaaatatccacgaaaacaatccagaataaagatgatgtttgcagtaaacaaaactgaatatacaacaaattcctaaagtcagtaaggaaaaagacaaaactgagtagaaaaatgggcaacgcttgtgaatagcaattcatacctgaaggaacacaaatcttccataaacattttgaaaaggtgcttagggaaatgcagtttttaaaatcatctcatagccattgaattatcaaagtttcttcataaggatgtggaaaattcatgttttgatacagctggtgggagtagaaatttatacaaccattttgtaaaggaatgtggagttatctgctttgttacgttggttctaagacgttcctcctccacctccacacgtactgtcccccactgccacattttaacattgcctaaatccaaatccatcttacagttgctgctttcttaatattttaaacaacattttgggtgcaacttacattagatggcctgttaggtttcataaaataagtagtaaatttgaagatgttcacccttttggatccagccatttgattcctagatgggtttctagaaaaactcacatctatacacaaagacatatacaatgctattcattgtaaaatttgattttcttttaaaagttttgctctaagaagctaaaaaattggtttctttcatgcttatttcagtaagaatactgttgcctacacacagagaaaaatgtattacttcccataagaggtcgagaagagttgtttaatttcctgactcaataatgatctcaagatctcagatttatcctatttctctgctttgccacagttggcttttagacccatttatttatatttgctcacttcctgatcacaacttccctaccttaacaagtgcaggggcttcaaatgatctcattattgctgctattgttttattttaattttgaaataattgtaggttcccaggaagttgcaaagatagtacaaagaggtcttgtataccaatcacccagtttctctcaatggttgcaccttccacaactttgaaacaatgtcagaaccaggaaactgacattgctacaatgtgcatgtatataattttaggtcatttgatcacatgttcagattcatgaaaccgccaccacaattatttaaaaccaagatggggagctattccagcaccacggagatttctctcatggcatccctgtacagtctcaatcatctccctaattccgaacatcacctaattcctggaatttttgttttccatctctaacattacatttgatagtaagacatagcaacttactttgcaaagcagcaaaaaataagatggatggatggataaatggacaaaaggatggagatatatggagtaataaggcacatatagcaaaatgttaaagaatctgggttgagggtatatggttgttcagtgtacaactcttgacatttgtctatatacttgcaaattttcatcaatataatatgggaaccaaattgatctaaatgtccaccagtagggaaatgaataagtaaattatagtatacactgtaagtatactatatgtctataacagatgattctatagcatttaacaagaaggaactagatcttcatttaacaatatggctaaatatcaaaaacagtatactgagtaatgaaaaggtatgtttcagaataatgtacatggtgcaactgaagctaacacctacaaaatatcagaaaggtaaccacccctttgaagtttttgttgcttgttttcataaatgattatacaacaacatcatgggtgacacctggatattgtcgagaacatgggtgcatgctatattctttttacttttcatatttgagatgcattactattaatgaaaatttaaatcaaaaaagaaacgccacataggtccacatacggtggaagatactggctcaaaattagacttcagagaagtgtgagtcaccttctacacattccttttatagtcgctcaaattatgggacacatttgccaattactttactttaaagaacaaggtactttgggagaaaacacattattctgaaacgacctcaatcaatgctagctttggatgtttatagaggtcccacgacagaatcagtaaacaaagaagcaggtaaatttaacacatttagtaattattcctgggagtatggccttaccactgcaagtgttggttaccatgataaatgaaacctgtaaagctacttgaaaatgaaacagactaagagcttgtattttgtagtcaataagcagatgtacacagaacagatgtttttttaaaaagctgttcatcatatgaaaaaaagctcatcatcactggtcattagagaaatgcaaatcaaaaccacaatgaaataccacctcatgccagttagaatggtgatcattaaaaagtcagaaaacaacagatgctggagaggatgtggagaaataggaatgcttttacacagttggtgggagtgtaaattagttcaaccattgtggaagacagtgtggctattcctcaaagatctagaaccagtaataccatttgccccagcaatcccattactgggtatatgcccaaatgattataaatcattctactataaaggcacatgcacacatatgtttactgcagcactgttcacaatagcaaagacttggaaccaacccaaatgcccatcaatgatagactggaaaaagaaaatgtggcacatatacaccatgaaatactatgcagccataaaaaaggatgagttcatgtccttttcagggacatggatgaagctggaaaccatcattctcagcaaactaacacaggaacagaaaaccaaataccacatattctcactcgtaagtgagagttgaacaatgagaacacatggacacaaggaggggaatatcatacaccagggcctgtcagggggtggggggctagaggagggataacattaggagaaatacgtaatgtagatgacgtgttgatgggtgcagcaaaccaccatggcacgtgtatacctatataacaaacctgcactttctgcacatgtatcccagaacttaaataattttaaaaaaaagctgttcatacttttcttatcacaaaatttaagataatgtttcctccagggaaaagaatgagttttgatcttttgaggacctggaaatatgctatttctttttctgggtggttatgacagttgtgtttgctttataattatacattgagccattcacatgtgttgtggatatctttgtattttattattattattattattattgagtcggagtctcactctgtgacctaggctggggtgcagtggcacgatctcagctcactgaaacctctgcctcctgggttcaaacaattttcatgcctcagtcaccaagtagctgggactagagttgtgtgccaccatgcacagctaatttttgtatttttagtagagacggggtttcatcatgttggccaggctggtcttgaactcctgacctcaagtgctccacctgcctcagcctccccaaagtgctgggattacaggcatgagccaccatgcccagctatttcgttatgttttacaataaaagaaaaggtgtcctaaagttgtgcaaattagtacttgcgggttggaatacaatttcttgtgaactcaaaaattgctagttctcatgtacttcggatgaaagtgaaattagcatgctcaggaaaattgtgggaggaattgtaccaatgtcagtttcctggttttgagtcaggaaaatgactcaaaagtgtccccctgttatgccagagaaaatcatatagaaaatgcatggaaaaatttgaatgatttactgaaatgcaagaaaagaagccttatatatacattataattctgtatataatttcaaatgtatgtgtaactaaacaacaaacttactatgatcactagatatgaagcaatgttatcaatgtctcacaactgtaaaaatgtacattggttaaaaatttttaaagggtgaagaatcttctagtagagaaaatgatgatcaccatgcatttggggccaccttatttgtggacatacacagctttccacaattatgatagctaacacaggatttttctcttttagattgtgtattgcaaagacttgtaaaaaaaaaaaaaagtcatatcttgaaagatctttacaaatcacgtttttccttttctcccaggtagagcaagagaaggaggggagagtttgatcctcctgaaggaaagattgcccccctaaaaacttggagataaagaaaaataatggagttgtcaaaaagatttcactctccccatggtcctgatagatatttgtcaactcttgtcagaatggcttgtcattctaatgctttgctcttccctgaaaaacaagaagctaccagcacgaaggcagaagagcaatgactaagacagaatctgcacattcctaaatcattatgcaggagggtgatatgccaagataaatcagggttgaatgggaaagagctaatgtttggtgaggaaatatttattatgggtcactattgcatcatttcagaataatgaggcaaggacagggagaggggataagtaaattcatgtgatggaaaatgaaattttaaaaacatatttacaattcatggaaggccaaaatattttaagtcctgggacagttagaaacttccttatttcacacaatgcctttgaaaaccaataagaacaacaacaaaaaaatcaaggggtccacaaaacaatttttagacagaagtgttgtttatttgatagtactaaacaaatataaattgagcatcctgagagcatatttgcatagcctattgttaggctactctttggtgatatccagaaaaaagttctttctggtattgattacatgaaactggcaccttcctataggacaaccaatcacaaggtgtgaaagtgatgtaaaatctttttgacgcacctgcaaggttcaccgtgggtgtttgtggaaactccttgtcaaaactctgttttacatgctattagtatacatagtcaaacacaacactgaaagaatcatgggtggcccagatctaggagacacatctgacagtagggagcttgggacttcaaaaagtcaaaagactagattgataggaggcagtgcttaatgcatagtaggcagtccataaatacttgttgaatgaatgaagtagactagatggaggtctaggagtgggccacttaaggtcatagatacatatgaaaccaagtatgcagggactcaactggcttctggggattggaaaaattccaggggtctttccactcactccagagagggggaagaagactagctcagcaaaaacaatgatgcaattaatctatgactagtactaaggggtggagttttccaatataagcattttatctcttggattaaaaacactgaatgggctgggcacagtggctcacgcctgtaattccaacactttgggaggccaaggcaggtggattgcaaggtcaggagatcgagaccagcctggccaatatggtaaaatcccatctctactaaaaatacaaaaattagctgggtgtggtggcacgtgcctgtaatcccagctactcaggaggctgaggcagaagaatcgcttaaacccgggaggtagaggttgcagtgagccaagattgcgccactgcactccagcctgggcaacagagtgagactccatctcaaaacaacaacaacaacaaacacacacacacacacacaaaaaccactcagtggtttcccgcttttcgtagaagaaagtccaactctttactatgattgtgcttggtcaacttctccctgaagcagatcttgaggatggggagaggtgataagtaaattcatgtgatggaaaatgaaattttaaaaacatatttacaatccatggaaggtcagcatattttaagtcctgagacagttagaaactaccttatttcacacaatgcctctgaaaaccagtaagaacacaaaagcatcattgagtccacaaaataatttttagacaaaggtgttgtaaattcgacagtacaaaacaaatataaattgagcatcctgatggtatatttgcatagcctagtgttaggctaccatttggtgatatccagagaaaagttccttctccttttggttatgtgaaactggtaacttcctataggacaggtaggaaagactttggtgcatgtgattgatgaaggaagtgcttccaagagatctggttagagaaggagaaggtaaggaagaatgtgacttcaggccatgttctaccctcagcctgaccccagagggagcggtggagcataaattgcacctgagtttgttctgcctcaagacaaggaaactagggacttgtgctccccaccagcaggttaactgctatgggatattccagggggtgccaactcagttctcaggataggtgaggtggttccaatagacccagagcgatcttctgtagaaggtcacatgtgccagccattagcagcaaagctggcggaggtatgcacagagctattaaaagggattggaggagatttggaaggggcaaaatatatgtctgctacaacagtcatttacaagcctacatgatgttgttccaccaagctctctatcctctgtccccaaggtcttatattagccaaggttctccagaaaagcagaaccagtaagttacgtctatctttctttctttctttttctttctttctttccttctttctttctttcattctttctttcttttctttctttccttcctttcttctttctttctctctctctctcctctctctctctctctttctttctttcttgtgggagatttacaataaggaactggcacacatgattataaaggttgagaagttccacaatctgccactgggaagctagagaccccagagagctggtggtgtaagttccagttcaggcacaggagaagacagatatcgcagctcaaaaacaggcagagagagagaattctttttcttcctttttgtcctattcaggcctccaactgattggatagggcccatccacaatgggcagggctttatctaatttactcagtctaccaattgcaatgttaatctcatccagaaacaccttcatagacatagaatatctagctacatatctgggtaccccatggcacagtcaaggtcacacataaaattaaccttcacactctcattagtttctgcactcaagccacaaagattctgtgcctggagtatgaatgcatagattgagctcgctcaagacaaaagaaggtaatgctagccaggagagtttagatgctgaattctgaaaataacgtcataaaaaggctacagtgacctcattccaaagaagttagtttttgattctttgtttatttgtttatttacttttttcttcagtgagtcttgtcctttaaagcacaggctacagactggctttttattttactgagctccagaagtcagaggaaaagatagaggcctttttcctgcaacatgaattctccaaagagcttatcttgcccccaagggggtgaaaattggctcttttggggacagggtgaaaaacaatcttattctttttatgtataaagcacagatatacatacagcgcattaacagatacacccagtgtatctctggttttaaaaatttcatggggaggccaggcacagtggctcatgcctctaatcctagcactttgggaggctgaggtgggtggattgcccgagctcaggagtttgagaccagcctgggcaacacgatgaaaccccgtctctactaaaacacatacacacacacacacacacacacacacacacacacacacaaattaaccgggcatggtggcacatgcctgtagtcccagcaactagggaggctgaggcatgagaattgcttgagtctgggaggcagaggttgcagtgagccaggattgggccattgtactccagcctgggtagcaaagtgagactctctcaaaaaaaaaaacttttttttctcattgggggatgattaggaataaatgtttaaattgactctgggagaagggaaacaataataatgatttgaagaaattaagaaagacaattctaaaaccataggtatctaaagctaaaaggaagcacctcctttatctaagaccttccaacgggcacctcaaggacccggatgctccaaacttcctgaagttcacacagggatttggtgagagagcctggcatagaccaggattttttctgtcctagaccaatgcacattccacgtgtttcatgcaaaacttcatgtatctgtgagcagggtccaagtctgtgcatctcattaacccacatccccacaaaggtgacgctttggaaaggaagtaaattatctacgtggtcaaattacacacctttgtaatccttcagaagagatatgttgtcttgctctctgaatggtgagacaaggaacagtcagagcagagagagaatacctagagagctgcaacatcggggcaaaaatgtatcaggaatcagaagcaacgcagagctcagagaagtgggagagaattagtgcagcgtaggaaattagccttcttcctgactcctcatacactcttcatgtctaaagttgacttcttctattgctgcttttttttttttttttttttttttttgagacggagtctcgttctgtcgcccgggctggagtgcagtggcgcaatcttggctcactgcaagctccgcctcctgggttcacgccattctcctgcctcagcctccctagtagctgggactacaggcgcccgccactgcgccctgctaattttttttatttttattttatagtagagacggggtttcaccgtgttagccaggatggtcttgatctcctgacctcatgatccgccgcctcggcctcccaaagtgctgggattacaggcctgagccaccgcctgtaatttgctgcttaaaatccatccagaagctgagggggtagggggtgaaaacatggaaaaagataaatgaaaatctagtgaatgataatgaaggttttatttatcatccaataaatcattgtcattagactcacctatgtgagtctagttttacaattctctgactgttccctgtctcaccactcagagagcaagataacatatctcttctgaaggatcccaaaagtgtgtaatttgaccacattgatcatttacttcctttccaaagtgtcacctctgtgggggatgtaggttaatgagatgcggagacttggactctgctcacaggtacatgaatttttgcgtgaaacacatggaatgtgcatgggtttagggttgaaaaaatcctggtcaatgccaggctctctcaccaaatccctgtgtgaactttaggcagtttgagcctctgggtccttgaggtgccatggaaagatcttaggtaaaggaggtgcttatttttcactttagatacctatggttttagaactatctttcttaaagacaagctcacctatgtgagttagctttaccattctccccagcgtctgtttcattcatgcatttatttgttcaagcatttattgagcacctgctatgtgccaggcattgtcctccacgctaacattggtggcaggaaagcactaagatacagtaataaaaatcagatttggtcctaactccaggcaaattttaaatttcacagtggagctaagtaaaataggtagacaagcctacattttaattaaattaccttccgttccatggctggcacgtgacgagcatattttctgactgtgcagggggaaatgggctgtgtcatatgtgcgagttccactctcctctggcaggcttcttaatccatgtttgagggcagtcaggattaaatgaaattatgggaacaaaaaacgaaaaatgcaaaaaaaaaaaagttttaattggcttactctgatcttcctgctgtgattgtatcaacgagttggcagcttgtcagttgcagttgccaggcaactctgagcggtaaggcgaacgtgtcagcctgtgtttcccatcttgtttgagtctcccagtgtctgggactgacgtctggttctacctgaccctccacaggggtctgggatgctccacgcagccccatgaataagcctctgacctgctgctcaaagctgcctcatggggaagtaattgataaaacttcagcccttattcaacaacttagctctctaactgtgaccttgctggaatggccccagggaccctgtctgagtcttcccagcccctcaggtacatcagcagaacaggtgtgaaggcagagacaggagaaacagaatgcctgcatcctcctcccctggtgagctacacatacttggaagccccattctgatgtcgtctttcctattcacactcatcgagcccacagagaatgggctttgcagtcagacctagctgggtccatctgttacatacaagccatgcaactttaaagcatattcttagccccgctgtgcctctgttttctcatctctaaagtggagctgaggtggaaaggtccttgagcctaggcgtttgagaccagcctgggcaacacagcaagatcctgtctctacaaaaaaataaaataaaacaaaaattagctgggtatagtggtgtgcacctgtaatcccagatactggggaggctaaggcaggaggatcacctgagcccaggatttcaagactgaggtgagctatgatcaccctcttcactccagccttggcaacagagtgagatctcatctcaaaacaaaacaaaacaaaacaaatgaaaaaaaataaataaagtggagctaacactacttctatcccagggtgttgatgaagttttactgaataaaaacaaatgtaaaatgcttagttcaatgctagcatatagttaatgctccacattttagcaactgttatccaggcatccatgaagaactttgaggcatttgtagaatcccggagctgaaaaggaagttagctagtgattgctgagtctcctcataccttaagtcaggaatctgagacccagagaatcaagagtgttgtacccaaagccatgtcatggggattgaaactcagggctcagttgccaccacaaaactttgccaggattgggtacaaaaaagaatcctcctgtattaaacatatcttgcaggcaatgggtaatagtatttgtgttgagtaatcagagaggcattcaacggacacagctacccagaagacagcctgtttggtctgagaaagtatcatgtgcttcagacagggccgtgtctcacagaagatgtctggttatttccctgctggctgagagaagatgatccacccactttaccatggcatccaagatgtttcttgacctggctatggctcccactgccgtccaattcccctcctccccattcatcttcctgttgatcctcagacgtgccagggagggtcctgcctcagggcctttgcatgagctgttccccttgtttcgaacacagatatccatacggctccctccttcacgtgcttcaagttgttgctcaaagatcatgccctcatggaggcctttcatgagtttcttatttaatactgccaccctctcaagcactttctctcctctttccctgattttccttaaaggacttgtcaccacctgcctcactgcctatgtgtttgcttgtcggtcatgcctgattgtagaggcaggccccacctttacactctaagctccatgagggcacagattttttgcatttggttcattgccgtattcccagtgcctagaactgcacctggcacacattaggtgctcaataaacatttctggaatacatagaaacctctctctgtgaggtttcctctgccctgcacctgccccatgttcattgtccttacccctactcacccttcatgaggcagcaacaagcgtaccctcctttgagaagacgtctgtcctcacctcctccaactggaatggagaccttgccatgtgcctccatagaatcctgcacctccttccagaagggcagccatcaaattgttgcaataactaatttgcctggtatcccaccagaagcttggcctgttctacaattagaggggcagtgaaagaaaaagaagtcttcctctgattaacttctctggctggttgtcagagaccaagcttcctgcctcccattccctgccccaatcccaaagcatttccctctagactgagccacttcagggcagggcttcatgtcatccatctttatattcccagcatacagtgcagctcctgacatggcataagggcacagcgctgttgctcaaataacaatagtcagggctcaccttgagccatgaaattggcctataagggctttccaaccttggcacttgagacgtttgaaatgggaattctttgttgtagggggttgtcctgtgccttggaaaatgtttagcagcatcgacctcaacccatatgccgaaaatacacacaccaattttgcaaccaaaacatctgcagacattagcaaatgtcccttgggggccacacttgtcttcagtttactgtgaattaattcattaaatcctcacagcaatgctataagggggtactgttatgaaatctagattacaaataagtgaggctcagagaggttaggcaactcactgaacatcacacagctaggaactggctgaatcaggatatgaactgggcagtctgactccaaagtttaggcaattaacctaatgaattaatgtcaggagtcgggtgaggaatggggatggtgtgtttattacatgcaggcactatttttagtttttaaatggattgcctcatttaattgtgtctagcctttaacacagtcattgttatttctaacattgtacagaggagggaattgaggcacagaaagcacctgccaactggaggcagagcggccagaattcaagcccacgcagtatgactctaaagcttacggtggtgggaggtggggggctgtttccactctgctccaattctgcacaaagtcatgctgccctttactcagctttccctgccaggacagcctggcacagtccctgtgttccctctgaaatagcttcactgctactcactctcagtgggcctgactcccggggcaccgagccctgagggtcacgatgagtgctttcaagttccaaagcggtcttatacacaaagccaaccgcaccgggggaaactgccagaggcttccccagggttgggacttccaaagtgggggcagtctttgtcttcaaccaaaccaggcttcacagaaaagcacgaggagagcccagaggggagatcttaggggtgttttcagaatatcatgaaagtcttctctgacaaaaaaaaaaaagagagaactatgagcaccttccccaatcccctccctttcagtagttaccgaagcagagatggtgtgtgtttcagaggcatctcctgacatgattgccctgatgtttacaataatgatcagatcattttcccacagccatttcatccaatgagcccaaataggattactgagaaattgcaaggtcttgcaggaaatttctcttctgaccttgggcattgttaggatgactcacaggaagcaagatcccctttcattgttagggaggacaattctgcagcctcttctccaaacagggtgatcccaaagtggtaaggaagagacattctgaatggcaatcatttatcacctgtgcacccagacacaaccacccactgtgcccacatgatggggagacatggcgtgtgactgtttctgtgagtctccactgtgaagcaatgtcagcttctcttatgcaataccctcagcttcagcgagatgcagagaaaaaggttatactagagcacaatcagttctccttcaaagacttttttctttttctttttctttttttttttaattttttaagacggagtttcgctcttgttgcccaggctggagtgcaatggtgtgatctcggctcactgcaacctttgcctcctgggttcaagcaattctcctgcctcagcctcctgagtagctgggattacaggtgcacaccaccaagcctggctaatttttgtatttttagtagagatggggtttcaccatgttggccaggctggtctctaactccttacctcaagtgatctgcccgcctcagcctcccaaagtgctgggattacaggtgtgagccaccatgcttggtcttaagacttttcttcttaaaaacacagcttgataagtagatgaggatagtgaagaccatatgagaaaagaaggatgagggcagatttgtactgtcagataccgaaatgcacactttaggtacaataattgtaatgataaatatgtatgggcaagaattggcaaaaggatcaatgaactaacatatatagctccaaaacaaatagtacacattctttctttctatcccttctttcttctacacctgcacgcacatacatgggcacacacatgtacacaataagttcagcactgtaaatcaataggaagaggaagattcatccatcagatcaattaatgtacccttgggaaaacataaatcactctaggtatttcaaacagtagggactttaatacagggaattgattacaaatgtgtagaaaaataagaggagcaaagtagagattgcccagggattaacacctgtaggaagccagtacattctctagagctggatgatgaaaagaggtattatcaagaagtcaagagtttacaatactgctgatgctgtcgccagaagcagaaaaacagtttctacacttttcccatttgtgaatctcatgtgatcgaccccactggtcaccatcgacccatacccagccgccaaggaactctggaaatatagttttcaggttccccgctgtggtgtagagtggaatagacataaggacaggcatagggctgagatttgacagaccatgtttggcaaagaggatttatttgataatgctacagaaggcagtgagctggtaactgagcaaaaacaaacattttcgcttcttgctgtaaagcaaaatcaatcccaagttgtgcaaagggttaaacatacacaccaatattcaaagacagaaaggaaaagaacagcaaaacagaaaaatatgaggaaaatgttatgatttaagggtgaccaataactttctaaatattgaggcaatgaaaaagttatgaaagaaaaaattatatattagaataaaaataatttctaatggtaagagagatgattacgaatcaagtaatctggaaggcagatttacaatatatattaaaatgagcttaaaacccaatgtattaccaaataaagatgaaactgtaaacaccagtaattctactggagaaacatgtgcatacaatggaatactatgaagcagggaacaggataaattttagtataaacattaacatgcacgaatcttaataacaattttgggtgaagtaaatcacagaagaatacttatagcactgtgccatttatgtaagttcacaaacatacaagataaacttcgttgcttacagatgcatgaatatgtattaaaactaaaaaatcaagaaaacaatgaccacaaatgtcagaactgtagctacaccagaaggcgggaggaaaatagttaagagagatatccaggagatttctaaggtacagaagtgctctatttccttagctgagtggtacatagattaatatttactaattattatttaaattatacgtacacatatttattttgatatgtgtcaaaataaaactgaaaaacaaaaaatacagacataaagaaaaatttaaaccatgaggtaatttgaatcaataatcaacaatattttggatcaaagaaccgtaaatttaaataatgagatgaaaattgattaataatcaaattaacaaagattctagatctcataattctcattgttagcatgagtgcgatgaaaaatcctattctcttggtgggggtataactcggttaaacattttgggaaagcaatttggcagtgcctatcagaagaatttttaaatgtccatgccttagggaaatggcttgaaattcgaataaagtttttatggctaaaatcatggtcattttagtgtttctataatagtgagaaatttagaaacattatggaagtaagtaaatcatgatagatataatgaaacattacccagcatttaatgatgattacaaagagattgtcattatcacagggaaatgcttatgtcacattatttagtgagaagagcaaactgcaaaactttatacccaatatgatctcatctattaaagaaaaacaagcatactggaagggtattttctttccacacagtcatgttacattgcatttcagcttttagcttggcattattccaagaacattctctcatggcgaggagatgggaggttaggtcatttccaacgaccattcttcatttctctcctgacttacatagtgatagagaaagaggaactaacagttatttcgtgttgtcttgggcaccatgttactcctacatattatccgtgtgagatagaaaatatcactcccatatgaacgttggagaaacggagtgggcttaaggcacctgcttaagagcacacagctagtaaatggcaaggtggtacgtctgattcctaaactgtttctgtaaactcccttccttcccatacggtagaacccctgaggcaagcctctgggatatcacagccttaataacttggctcagaaatcagtctgcctgggctgagatactgcctctacttactagctatgagacttcaggtaaattttatttaatttctctgggcctcagtttctgcatcagtagaatgagaataataatgccttccttataagataagatgcatgtaaaatgcttaggaaagttccaggcactcagtagaagttagccaacattgctgtctctaatagggtctgagtaaataatgacttgtttgaggttatttacactctcacttgcccagagtctcctggggaataccatcagcgatgttctggtccaagacataatttcacagatggggacaccgaagaccagaaaggtgaagtgagtaagccagtccacccagtggtaagtgatcgggggtggtcctgactattactgcatattctttccatcaatgtacagcatttccctgactgtcaccccctgtgaccagatgccaggaggaccagaccacaaccttgaaaaacacagccatctcttcatgcacacactattatttatgtatatattatcatttgctttctcaacaaccctgggaggtgagcaaggtgtttctccttggtcccataaggaactgaggcaggaacctcagagttctttgcacaacatcatggaacctccaagagttttgtgtcttggctgcattagatgaccaaattcagatctgtttcttataggcaggaaagaagttgggctggtgaattttcctgatttctctctctctctctctccctctcttttttttttttttttaacagggtctcactctgtcatccagactggagagcagtggtgtaatcttggctcactgcaacctccgcctcctgggttcaagcgattctcctgcctcggccttccgagtagctgggattacaggtgcctgccaccacacccagctaatttttgtatttttagtagagacgaggtttcaccatgttggccaggctggtctcaaattcctgatctcaagtgatctgcccacctcggcctcccaaagtgctgggattacaggcatgagccactgcgcccagcctgatttctctcttaaaccccatggtactagctgttattcaccaacatctgttattcatcaacatggacagggaagcagcttcctccagctcttcacttgtggggctagcccattaagctctccccagagctcaggtggccaaatatggggactgtgacagaggttaggccagtgggacagaagtgatgccatccttcttcttcccaacatcacccctgctgtctacagccttgaggttacaattcctgccttacttatgcatgatgttagcctgtgatgctttctgatgcctgacagcaaccaaaactcccatgagcttgtggtgggggtataaattgggaaaaaatccttgcaatgtctcctaaggctaagcgtacacctccctatgatctagcagttccactcctaggcatatactcaagtgaaagaagtgtttatgttcatccaaagatattgatgaatgtgtttatgactgctttattaacacaggcaaaattgcaagaaacctaaatgttcaacaataggaaaatggataaataaattaaggcaatatttattcaatagaattttgtgcagcagtaaaaaaaagtgaagtacagcttcatgcaacagtgtggatgaatcttgcaaatataatgatgagaaaaataaggcagaaacaaaagaacacatactgtagaattccatttatataaagttcaagaacaggtaaaaccattctattgtgctagaagttgaatagtgtttactgttgtgggcaaggctctactgattattaagggaggaaaacttctggggtgatagaagtgttctgtttcttgaccttgaatggaggttctatggatgtaacatgtgaaaattcattatgctttacattttaaaaatgtgcactttgctctatgtatatacaatctttaaaaaaacaaatcctgccagctggatcactaaggattcattcaccaagaactcagaataatccctaagcaaaaacccctaagataagcttatcttttaagtcaatcagtggattctgtatataccaagtgaatttttctttctctaagacccaacctagcctgggatacatctctcttctcagaggtgttgctgtcattgtactccctgagctgctgctgtgtgtgtctgtctgcccctcagaccacatgccccaagagcagagactatgcaccattcattgcctttccccagtatgtagcacagcgcctggcttagacatgcagtaactattgatggggtgtatgaaggagtgaatgcacaaaagaatgaatgaacatggcacacacaaatatgatctatgaccacaatctagaaagctcctgcggggctgtgagctgtggaatcattctttaggcagcatgatatgagccagtggttctcaccctggggaaattttgtaccacaggggtcatttggcaatgtccagagttaattttggtgaccacaactggggatgggaggtgatggtattctacctggaataatgctaaatagcctacaatgcacaggaaagcacacctcttacacacacacacacacacacacacacacacacacgagtcatccagctcaaaatgtcagtagtgcaaagattgagaaaaccctgatatagaggaacaggagctaaacgcaggaagaaagccttgagttcaaatgttaattgcctacttattagctgtgtgaccctgggtaagttgcaaaacctctcagatctttctcctttgcactaatagggctgatccctaccttaaaagtagatgagaggattaaatgagctaaactatgtgaagtgcctggctcaaaacaggagcccagtgagacttagagaccttctcccaggagcccaagagactttctcttctccactctgtttctgatcccccttccccagagccataaatgggcaatttttagtaagaaaaacagctgtcaagcattgctgcttcttcctctgcttaagaaactattgaagagcaaggctgcctgtgaagaatgcattttatttgccaggtacatcaatagcccctgttcctaatgaaatgcgttattaatagataaagtcaacatattcagaactcaggcccacgttgcatcccaatgtaatctgccattctccctgccttgcaggtgtcctctaagcctgcctctgaaaaaccgattctgattttccccactttccctcgcttttctctaagccccaacaaacacaatgagttcccaagagatacagagaaacgtcacacacaatactagcactgtgtgcaggtggcagagacatcgtgaagaaagaacccagccttgttctttgcaaatgggaagtagaatttcccgcagggctcaatctaaggcttgctacatttgttccttcctcccctttatgtatttatgagagcggccggcccctaggcaatcctaaggtggatgcttatgggtgctgattacgatgacgttttgctgtccttggtgctgaaaaagtcttcaagtgctaaggattatgcttttccattactcatattggccagggactataaaatgggcattaatatacatgttaacattatttagcaaatgcttagtatagaacatttgggaaacacacagaatgaaaacaacaaaaataattagtatttactgagagcatgctacttttcaggcatcattattgacttcatcttgtgagctatgtattacatattccctatttttcagatgaggaaaactgaggcaagaacagtcccattcacatgaactttcagtgacagccacatcaacaacataagaacacctgggctcctacaaagaccaattgcactaccggctctggctccagtctttcttcatcttctccacaacttggtttgtcttggcccccacaggtacctttccctctcctgaaccatcatctccagtctttctactatgccattttctcactggcacacaaatatgcctcaggatttctcatcttacagagaagacacaagactcttggccatcacatccaaacctcgaataactttctcattcatttcctccttttcaaggagaagttccttgaatgagtggtttttagtccttttttctaggtttacaccttccattttatattatttcctcaaatcaccaccaccccccgaaatggaccaagtcaaaatcaacagtgatcatcccattaacaaatcctatggttgcttctttgagcacttgttttagttcccagcaaatctgacatcaataactactcccttcttcttaaactacttactttttttctctttaccattgtgtcaccacaaaatcctagttttcctcctaacttcatggcccagattctcagtccttttcctggacctttctcttccactccccttaaaatactttgtcccagggctcagttttgggaagccttcacttttccaactctactcctcttccagtgagcaatctcatccattcccatggctttaaaaaccatccatatgttgatgcttgctaagtttttatctccaggttgaggcaattgtatatatctccaggcaatcattcaattgtctctccagtcactacttggatgtcttataatctcaaacatcacaaaattaaaaagtacttttgacgttccccccaaaatcacctcctaccctagtcttccccaactcagaaaatgccacaacttagtttctcaaaccaaaatcctaggaatcatcttttatttcccctcatggttcacaaccaatcctccaatcaagttccacagacttaacctacaaaatataccccaatgtcatccacttctttccatctcccatgccactaccctagcatctccaccctctcttcccaggatttttaggaagcctcgtttttccaatttgagctttgattgagtaggtagtacacatattcaaaaatttaaccatattggccgggaacggtggctcacgcctgtaatcccagcactttgggagtccgtggcaggtggatcacttgaggtcaggagatcgagaccatcctggctaacatggtgaaaccccatctctactaaaaatacaaaaaaaaatagctggatggggtggcatgcacctgtagtcccaactacttgggaggctgaggcaggagaatctcttgaacctgggaggcggaggttgcagtgagctgaggtcgcgccactgcactccagcctgggtgacagagcaagaccctgcctcaaaaaaaaaaaaaaatctaaccacatcaaaatatatacacctccatcccccattgctctggtcccacctttacacttcacaggtaaccaaattttcacttcatttttaaagactccttcaagagtctttatggaaatacaaaatgtccattcctcctgtgtttttacagaattgttaaaacatcacgcattctattctgtttcttgctcctttcactttgccctacatcttggagatcttcccacatagatgttgaagagaacattctctttagttgcttagcattccatcatgtggctgtgacaacatttatttcactggtaatctatcctttgacaattgggttgtttccaatatttttctatttcaaatgatactgcaatgctcttgtatatactattctcatacatgccattatatctgcattataaattaccagaagattatggaatcaaaggaaacatgcaaaaaccacttaactgatttctctgtttccactcttgacttctacattacatttccaagggcatctacagtggtgtttttcaaaatataaatcacattagtctgctccccagctcaaagccctccagtggctttctgctgcatgtatatggatttaaatgcctgattttagtctccaatatctactttttttgcactttacctacttggccactcatcaggctccagcaatttgttatatttctagagcacacctaactctccttgccttgacacttgctcatccctctacctggcacactcttcaaccagatctttacattttccctttctatcaaccagatctttacatttcccccccgccccccatcttcggatcagcttaaatatcacctcctcaggaaggcttccatgatacatcatctgaagccctccaccctcaccctcactgctgattctattccagtatatcattgtgttttattttctttattgctcttcctctttctatcccaagcccttaaaacagtgtctgataacaaatgtttgttgaattagtgacttaacatctcagtaaatttacttccagcatctttccaaaaagatattttttacataggtgagatgaaataatgcaaataattttctttccttttatcatctagtgttatatttaagcatttctccaggaaattaaaacttctttgcaaacattctgttttatgaattcaggacaacttatcatagggagagattacaactttttatttttttatttttttttatttttcatttttaattttttgagacagagtctcgctctatcgcccaggctggagtgcagtggtgcagtctcagctcactgcaagctccgcctcccgggttcaagcgattctcttgcctcagcctcctgagtagctaggactacaggcacacgccaccacgcccagctaatttttgtatttttagtagagatgcagtttcaccatgttggtcaggatggtctggatctcctgacctcaagatgttcccactttggcctcccaaagtgctgggattagaggcatgagccactgcacccagctgattataactattttaatcattcactttgttaggtagataggtttctacaatttttgttatttgaattaacacaacaataagcatatttaagcaaaaatatttgtctataactttgaactggatttactaggttcaaagggtaaaatctgtttcagcaaccagatactttttatcaaatagcttctcagaagattgcaataacttacaaccttctagcagtaaatcacccaatcttcagcagctttcatattttcttcagtatttactaatttcataggtaaagtggttcatttcttaaattgtcccttcttataactaatgaagctgaatatttatttagttcgtctttgactgatttataacaacattatatcaacacccatttccacaggcttacaaagagtttggctgtattaaaacccaagacatcaagtaatatggctgtgaattttctgccatgggaaaaaaagtagtaaaccacctatgggattacagcataagtacaacttgcttttctcttactttgggaaagatgaacctcctttatagtacaattttcaggaaatgcattgcacttcccttgttttccacataggatgtaatttccagcaccactgcaacatcttccaagggaggcatttttaaatcactgacagatattgtgaaggttccatcatggaggttccatatagcgacttttgttttgcattttcctggccatacttctgtttagaacctaccattaactttgataatttaattttacccctttcctaagaataaaatccatgcacatgtcagtatcagcaaaataacatcacttctctcttctatagcttcagctaacctttaagtgaatcttaaaattttctataaccatcttccaaaactaggcattttatccaataatataaaattagcatgttatagagggtgctgcacaaatagcctacactgattcacagatgactttaaaaattcagtgagccaagaatcccacattattgattcatgctaacaaaacgatgaagtacagctaatctttaaaacacatgctgggcagaatgacatttataaatgcagacagaccgaaaccaattggacataattctttacggattaaactgatggctgcaattagacctaagaaggtgagcagtctctctgctgggaactgagactcagcctcctgggtccaactccaattttctctcatccttggctaaacatggtattccactgttccactgaccggctagttgagtagagttccccatgactactcaggttaactaaattggtttgtaaaatatgacatgttaccactttggcttgcctctttgacttttaataacaactgccccgaagggggctatgattaggatcatcatagcatgatgctatcagtgtagaataccagatgagcccagcaaagagcctgtagggacagaatatggatatatccctttgtatctgccctgtccctctccctctccctctctctctccctccccctccctcccgccctcccttcttccttccttccttccttgtctccctccctgtctctctctctctctctcttttgacatagtcttgctctgttgcccaggctggagtgcagtggtgcaatctcagctcactacaacctccacctcccaggttcaagcaattctcctgcctcagcctcctgagtagtgggattacaagcgcctgccaccacaacttgctttttgtatttttagtagagatggggtttcaccatgttggccaggctggtctcaaactccggacctcatgtgatcctcccgtctcggtctcccaaagttctgggattacaggtgtgagccaccacacccagcctaactatgtttttctgtttaaagaaatatctgggcttgactcatagctcccagtcctagggaacaattctgtctgccatttcagagtagtttcaagattaggctgataaacatcacccaaagaacagaaattcttatagtcacccaaacaacagataactcttatagtcttaaaattcataatgattctgcttattagaaaagcttattagaacagtgatagggtgagaaatattttgcagccatgcagtgtgacagaaagcacctacgctgggaaatcaaattctgtccctgtcacttagttacacagtgagggctccatacatgttattatgtcctagtttccccactctacctacaaccagcagggttattttgagactctcttgagatggctcagggaagctcttaaaagagcctaaagcacatagtcttaaaagaactgccatccacatttgatggtctcttggctcgctctctcttcttcatcttctcaccgcattcttttccttctttactctttactatgcgcttaacattttgggaaccagcaagaatacacccaaagagaaactccaggagcggggcaatttcagggacatggaattagcatttctataatcgttaggactctcttgttaaaaatgagtaacaaacaaacaaaaaccttgaattactctgagaaatggaggtaaagttctggtcacatagaacacaagttttgtcccaagggcataaaatctccttgacaggctcaaactcagtttgaaaattcataattattcagtttaacagagggagaagggagactgatggatggaggatgatggcatgtttacttgttgcagcagtggggtagaacacaaattccaacttttcaaataagaccttcatggagtaagtctcttctactaacgggctgtggaatttggggcaactaactgtattagtcctttttcatgctgctgataaagacatatccaaggctgggtaatttatattttaaaaaaaagaggtttaatggaatcacagttccacgtgcctggggaggcctcagaatcatggtggaaggcaaaaggcacatcttacacggcagcaggcaagagagaatgagaaccaagtgaaaggggtttccccttataaaatcatcagattgtgaggctcattcactgccatgagaacaatacgaggaaaaccacctcccatgattcaattatctcccactgggtcccttccacaacatgtcggaattatgggagccacaattcaagatgacatttgggtggggacacagccaaatcacatcactaacctaacctcattgagcctcagttatctcatctgtaaaatggagataaagatgaccatagtaaatagaactaaattcatgactcaaatgatgtcatgaagattcactttcttttttaaaatatcaataattattttatgtggtatacatttaaggggtacaagtgcaattttgttacacacacatattgtctagtagtgaactcttggtttttagcatgtccatcacccaaatactgtacattgtacccatgaggtaattgatcgtcaccctccccacttccactctctcacctttccaagtctccaatgtctattgttccatactctacgtccatgtgtacacattatttagctctcacttacttctgcatcttttaaccctatcttttgccatgcaagctttgttcttaggatcctaggtgctcccagcttctccagccttcccctaggttaaagtccagctaaaatgcaggcgcttcacccaaagtcctgaggctatttgattggcctggggaatgcgggtgctgattgaagcctgagagtccttttccatccagaatcctggagtcaacccttcccaaactgtgtgggatagaaaatggaaatgggctaggcgcgatggctcacgcctgtaatcccagcactttgggaggccgaggtggcgaatcacctgaggtcaggagttcaaaacctgcctggccaacatggcgaaaccccacctctactaaaaatgcaaaaaaaaaaaaaaaaaaaaaattagccaggcttggtgatgggcacctgtaatcccagctactcgggaggctaaggcaggagaactgcttgaacccgggaggtggaagttgcagtgagccgagattatgccattgcactccagcctgggcaacagagcgagattccatctcaaaaaacaaagaaaatggaaatgataaatgtctagagtgatggatatcccaataaccctgatgtcatcattacacactatctgactgtattacaatatcacaaatacctcataaacatgtaaagctatgtacaactattacatattcaaaataattaaaaatgaaaaagaaagtggaagtggtggattcccaaacaaactaggaagctgtaaccagaagatgaaaaaaatgaatgcaccagaggcaaagcacagttgtttgccatgtttgcccagctgaaaatcaacggcaatgttttttgtcagtcattcttaaccctggttgcagattaaaatcacctgggagctaaaaaaaaaaaaaaaaggatggctgctatctgggcttcaacttcagaaaggttaaatcaaactccctgaatgtgggaactggacagtggtggtttaaaagcacccagatgatcctaacattcagccacggttgagaacggtgtctatgtagacttgtgtacacatccagaagggatgtttaggtgggggattttcttctgaaacttctatacaaaattagaattcccatctaagaagttggaaagactgcaaatttagaagacactaggatcttgtcagtgttgctacttctcaagtaattacagaccctcagagtctgaaagattcgggctaacaatgagttacagcctccattcaaaatatgaatcaactccagggcagtctgatgtccagttttttcttgtacgtctctaataattgtgaactcatgactttatggggtaacatagtctattttgttttttgtttttgtcatagctgtgacttcctaagacctacatacgagaattctgacccaaagctctaaaaaatcacctctctctataatcaatatgacttaaaatgtactctttgttatctggcacacatccacagctagttagcaatagagctggaagttgatccaggtttactttgaactacatatacatatatatatatatatatatattttagatggagttttgctcttgttttgttgcccaggctggagtgtaatggcgtgatcttggctctccacaatctctgcgttctgggttcaagcgattctcctgcctcagcctcccaagtagctgggattacaggcatatgccaccacgcccagctaattttgtatttttagcacagatggggcttctccatgttggtcaggctggtcttgaactcccgacctcaggtgatccacccgcctcagcctcccaaagtgctgggattacaggcatgagccattgtgcctggcctaaactacttcaatattacaccatctatagtaaaaaaaaaaaaaaaaaaaatggggaggaaggggtgttaataaaactgaaaaagctggaaaacaaaatgatgtaagtaaacccaaacaaatgtgttatggcaataaatgtaaatcttttaagctcccacttgaaagtcagagactctgagattggatcaaaagttaaattcccaccttatactgtttgcattagctaagcctaaaacaaaatcacatatttgggttaaatgcaaaagaagaggcaaacaggtgccagtccagtacaaacaaaagtcaagccagaggcagcaattgaatgtcaggcactgtagaattcaagcaaaataccttaaaatagaacaacaggattgttttatactgataaatatccaattcacaaggcaaatcaacagtcataaatgtttacttgctgaaatcattaaacacctagagctaaaattactagcaatacaagagacaaatgacataaacacaatcaatggtgtgagattttaacactcaagagtttttgacagattaagtagacaaaaataaataaggatgcagtggatctgcataatataattaatgctgactgaatagatttttaaacattatatcaagaaaataattgaacttcttgtaagagataaactaatacaatttccaaaatatatatcattttaggtcacacacacccaaaacaacaaagtttggtaagtggtagttcaggtcacgttctctgggcatatatagaaaatactaatgtataaggatatataggaaatgtatataaaatggtattctgtgggcatccatattagaaaacacttcaaaatctaaaaagtaaataaatcaaaaacccatccaaaatttcaaaaagctaaaaataatttccagatctttcaaattgaaaatctgtctcctaaataacatggtagtcaaagagaaaattaaaatattggttatagattacttagaaattaatgatctgagaaaaacaatatacaaaaatgtgataatccacaatttcagcctttattaaacaagaaaaaatgaaattcactgaggaaagcacagcaatgaattttcttcaaagggagcaagtaaaaactaagaaaagcataaggaataaataaagggcggattttaaaatcccaataattagaaaagcaaataatctgtatagttaatatataaatctaaatggtgttttgtttgtaaacagaaatattaacaatttagaagttagaataatagctaatgtttattgagcacttagtatgtgcctcacagtgattaagtatgttattaacaataccacaggctgggcgtagtggctctcacctgtaatcccagcactttgggaggctgaggcgggaggatcacttgaggtcaggaatttgagactagcctggttaacacagggagatcccgtgtctacaaaaaatttaaaacattagccagatgtggtggtgtacatctgtaatcccagctactcaggagggtgaggcaggagaatcccttgagctaggaggtagaggatacagtgagccatgatcaggcccctgcactccagcctgggtgactgagcaagaccctgtttccaaataaactaacaaacaaacaaacaaggagggccctattattgtcttgattttacaagtaaagaaattgaggaagacagagaggaccacaatgggcccaagagcacccaagcggtgagtaacagaatgacctaagctcctaaccaacactttatataacctctcaatatgaagaatgagggtaaaagccagaaattagtaattacaaggtaattgaatatatatactaaacatataatttcatgctaaataactctgaaaatcttaaggatatttatggctttcttaaaaaataaattataaatattgactcagttggaatttgagtatatcaaaagtttaggagaaattgaataagtcatataaaaatcatctctgaaggaagtactaggcctaaattattctaaatgttcaatatttcaaaatttggaaaaataaataattcccatgctaggtaacaatttaggaagaaaaaaaatgtgtcctgatttctctaatgaggttggcatgagtctgttgctgcgacctaacaaaatccaaagaaggaagaagctctgatccaatcttacatattgatatagctataaacacactagataaaatacaagcaaacctaattcggctatgcttttgaaggataattcaccacaaccaagtagattttattccaagaaaccaaggatgatttaatactagaaataatttagtattcagaaatctattcacatcatttatcacaccaatgggtcaaaggagaaacatcatagtcaaatagtacaaggtctttgacaaaatgcaataccatctcttatttagtctttaaaatgcagaaatcttggaatagaggagtatttcgctaacattgtaaagaatagttctcatgtatcaacagctgacactttactgaactgtaaaataccagaaatgctcctgttaaagtcatggacaaaacagaggtcttgcttttcaacagttttagatactgaagaagacaaggaggaaaactaaactttagtttaccaccagcttggaagcacaggcattgccatttgacctgggcttggattttggctgcctccctctccagtagttgagccctattttggtaaatcagtaagtcagtttcttctgcatgaggaatggtaaaaggacagtgaggattaaataagcagacacaggctgggcacggtggctcacgcctgtaatcccagcactttgggaggccgaggtgggcggatcacgaggtcaggagatcaagaccatcctggcttacatggtgaaaccccatctctattaaaaatacaaaaaattagccgggcgtggtggtgggtgcctgtagtcccagctactcaggaggctgaggcaggagaatggcgtgaacccgggaggcggaggttgcagtgaacagagttcgcgtcactgcactccagcctgggcgacagagcgagactccatcccaaaaataaaaaataaaaaataaaaataaaaataaaaataaaaataagcagacacagagagaccccttggcacaatgcctgatgcagggcagcgtctgaattcacaactgcttccaggctcagaaatatcagttgtttctttactagaaaacatggtaaggtcaactgataaatgattagaagtacccaagagtttaataaaatatccagaggccatctaaatacatacaaatagcagtgaaaattggttagaagttagaagtgtctcaacaggcctcttgctgacaattggattttgtagactgttgtctttactgcaaggccctccccatcccattgttgcctcatccccaaccagccattatcttataattattgtttaggtttcaaatcattcatcactccttgtggaagctttttctgacccccaagccaaaccccctaccaagtgtacttttaactggatcatcttctttgacacacttgccatagcagaagttttatatttttgtagaattattggattaatatttgttttctactcaaggcttaagttctgagtacactatgcagctattaaaattatgtttatgtaaaagaatttaatgtctacatatgaatttatttttcaatgcatcatataaatcagtatataagcactcaatcttcatttctaaaaattacacattagtatatgcataaaagataaaaagatactcatcaatatattaacagtaatactagatttttattatttaaattttctttctcatattcattaatgcttttaaatatttaacataaacaaacagtatttcttctttaaatgatagggatttgccaaatatctaaatttttaaaacacttaaaatagatacttttcaatttttttttaacatcaggtgacaggtgtttaggtggctggtcattgatgctgaccacatataaatatatatatatatattacctagaattgtcttctttcaaaaatttatctttctgactggtaaaatgttattcctaccgaagagagcaaagaattgagcacattaaaaaagaatcagcaatgatggtaaaatctggagaaatattttactctcattaatataagaacaagcccatatctcagcccccacacaattaaacatctagcaccccttcacttacacacacacacacacacacacacacgacaatagcaattggtcaccaaatgcacactgagcatctactacgtagctcagcccagagctagctgttcagagggcttagtccctgcccttgatgaggtcattggccaccgagaccaacacattgagaaaagaaaaccaacagcacaaaatggaatctgaacactgacaaacaagtgttagacagtagttttgcacattttcagagttacaccttcccacccatcacgggctgccagcagaactcccggtggtggtgtgaatcaactctatttccatcgtagcagtataaatagaggaatgacttgaggaactccccgtgctaaccaaatacattcaaacacctttattggggtctgttcttttgccaccccctagctggggtgttgtcttctagtctgcaaccacagagcagtgcacctgccaaaacttcttcaaatggtcttcttccatttggggcatctgattctgctctctcctctcccacaggaagcctgggtcaaatgcccatcctcctttttctcacagtctcctaaggtccttttgttactgttcttgacaccctatattctactttcttcttgccctctctgattcaccgaccagaccaaagctcttcgtagtcattttttatgtatctcagtaggtccaattcctagctctgtgttctagacatactttgtgcttggcaaatatataccactttcaatcaatgaagaatgaataaatgaaattcatctctggacacctttacaaccttgcattccttgcctttgcttaagctgttccatgcatctgagatgcccttttctcaactcatttccatatgttcaaatcctaacctccatccttaaagttctagaatgaatgccttctactccaggaaaactcccctggcctctcggccatcagtgacttccccctcttccaactactacagttctttatcaatttcccacattctacccagacttagtgttattcatggacatatttttacatgcccctccccattaattgatatactctgtgatgtcagagactatgtgtctcctctatcctggtcctcctcccagtgaccacattatagacaataaattaataatagacttattatggacacatgcaggattagtgccttggagatgtcagccctttgttcatttcttccatggctggatttggcaaatttgaacagaaggagatatggtaaagacaagctcttggatcttattaggaactcaaatatttccattcctgccattttttatgggatgtgttttaacttggcctaccaggaaatgtgtgtgatttactataagtatccgaatgaacttaaagtgtcaggagaaacatgagaccatcatctgagtggggggggagggtagaaattgatgaatgaaattcttcctggaaatacattcttccaggagggggatgcaatgacatctccaccttgtctcatcaaagcatacttctgaagagagaagacttggtggacacaggtcaggagagctggctgaccttgctctcctctaatttttgagctttcccaaacacactatttttcttctcctgcctgggcttgatcttggcggctcatgcagcaataaggggagttattttggggagacagttgatgcttggcgagtcctcctacagatcagcaatagctgtttgaaatgttaaatgcctcccagatggagatacttagcatttgtaggaggaataatttggaggagaaaaatgcatttgtctttttggcatcctgtggattgcgttacagaagacagagaacactgtgaatcctgccatccacatgtcagtgttttcctggaattttgctagtcccaggtgactgtgctgctgctgctgctgcttctggggacatcaaggtttggatatgccaatgctcaagggaaaagtatatgggactgagtctcagaggtcagagagcttccagagtgcccaggaaccatcagggcttagcctcccggctaccattggcaaatgcttcaatcatgtagaccagatggtttttacttttgggtgtggtcttttatacacagggaggctgaaaaatgtagtgcagactagcagagagaaccagggattgagaggcatgagttctggccttgcttttgccactaactttctttgtggcttcaggcaaaccaccttgtctcacaaagcctgtttccccacctttgaggtgaaaagattggattagatcatctttaaattcttccctaactaaagaacaatgctatggtacttgttgtcatggcttatgaagaaggtgacattatggcagaagggtaactttgagttttccttcaatatgagcttccaggtgctaaggaagagaagacttcattcaattgttcatcatgccccattattcatggcaaggatagagtgggtcattcacaaaaaatactgaatcaatgacccttttatttatttcttggcacccatgagagctctgtggcccatcagtaagcttcatcaaaaagttatgcctttgagtaagcagccacttttagcaccagagtgaatttgagctggatagaaagctcagttctgaaaaattgtaactggataattgtagtgtaagtgttctcacaccacactgagatgtgcaaagaaaagtgtgcctcctttatcttctatgctagcctcacacacattttagaaatcccctcatcccctcaggtaggtgggtgggtggatcaggggtgctacatttagttaaatccagtcagctttgtcctatgcaatgatgaaaataatctctataggaaattcatgctcttttggataatgctgtctttccaatttctctcttctcctcctgatcattcctgagatagattctgggtactggggagagcggaagaaggcagccttgggttcttacatgttttaggctcccctgtgccctgcagcaatgcactgtgcccctctggtcattggtcattttatcaggatctgatggaaaagctggggctgctaacttatgggctattttcctactttgtctggacacagattctgacttgacctcacaatggctgtttggagggctggacatacctgattccagtgtgccctgctctgggaaccatataacatagccctcagttgcagagtaatgtatcccaccctggtaaaccccctagatggaatctcagctacctttctcctcttccatcatgaggcatgggtaaatagtttgattcattctaccatacaagattttagtgtcacttgggaataataatgcaacccctttccctctctacccttctctttctctgcatctccgtatctctaactttgtgtttctcttccctccattgttatgctactatcactttgctatggaagtctcaatgttggttgaagcagcttgggaggtgtctatttcccgaatctcaacctacatccaaggcttgagcctcagaagagataggaaggacccatgcacacctcccagcatgagagcatcctcttttccttatctcaatccattctgagccagaaaaacacgtgatttccactttttcctatcctgtgatggttttgcctatattttatcctcctgttttctgaggtaaatttcttttcctcttgcttttcctggggaaaatggtacaatggttgcctggaaatgcaatgtttgtggtataagataaaaacaaataaataatattttaaaatattatttccattacaaaatcatttcttaaattgctgaaagagatttgcttgactgaggttgatacactttcttctctgtgagccttccacctataaaacaacatggttagacctcacattcattaaaatcctttccagttcttgtgtcttagtctcacttaacaatgagatgctataagaggctcacaatgctctccagataattttccaaatgagtcattctattcccaaaccagttagagtatatttgtttggcatcttaccaataaaaaaaaaaaattgagcttatcaatcttttgcccagctaaaccctactatgagtcctgagacttaatcatttactactaagtagctacggatacagtttatccaacaagactagaaaccacagaataacccatgaagaatccagttaacacaggaagtgactttcaagtcagaaaaaggaggagaagcaaaccaaaatggcagctgacaagaggaattaagttctcctctaactggctaaagcttgagactggtggcttctcataaggtgaaatgggaaagcccagattccagacatatcaacacagaggtcctggtatatcctattgtaacaaggaattaactaaaatggagcagggaaacttcctggcggattccaagattctgaaagtgaaaaggctgaaacatgatatctacacacaaagtgctctaaggaaaagaatccaggggcagtggttgaaggcttgatgattgatctccaagttgaagttgtctcagttgctctaacatatgcacataatctcccccactttatacacaatccatacattgtctaggattttgtttgtttgtttgttttttgagatggagtctcactctgttgcccaggctggagtgcagtggcaccatcttaactcactgcaacttccgcctcccatgttcaaacgattctcccccctcagcctcccaagtagctgggattacaggcactggccaccacgtccggctaatttttgtatttttagtggagacggggtttcaccatattggcaaggctggtaggatttttttaaacaaaaaaaaattgtagtaattatgaatggcacattttagctattctaagtagggatgagaaagtgaactctgccattcagaaaaatagaataaaaacatctttctgggaggatgtattgttgaattgttatgttccattctttttgcctatcaggaaatatttattatggctgctgtatgtagtgtgccaggcacaatgggatactgtattatgcagcacaggttcagtccctaaccttgctgctaaaaatcaagtagaagaggtgagaaaataaaccaaacattccactaactgtactaagtgctaacataggcgatgtagataggtgtctggattcggatttctatggaagctctaacttatccagtggtgaggaaggtgagaagtcaagaaagtttccaagaggaaataaatttcaatggacagaactagtaatcccaattggcctccataaagacactttccagcaaaaggagataatagcctcccacatttggattcccagatttcagccccaatggcacttgagttgtcagactcaaagaagtaagacatagtgtgttttcctcaacctctctccacctcctacttgagcccattcctaatctatcggtctctacttataaatatctactaaacttccagcagctctgcatggctgcctttaatgttgacacagagaacaagagggtgatgtttcttggagcttcccaaactacaaaaaacctgctaacacttgaaaaccacaaccctgacaaacacatcatagtctgggagttccagcactgagccaattttatgcatgcatttatttgtttgtctaaagggaaggactttcttcaaccactaaaagagttcctcaaaattccctagttcccaatgcaggcagacatgaataatgtatttaaggctgctttttttttcattccttgtcttccagcagccctcaggggctgccatattgagtttcagcactcacaatcctggtcgcaaggaagaacatgcctagaatcatgcattgagtggccaaacgcaccccagggcctccagttttatccccttaacaagggacttgaagagtctgctgaacaaccagctgacgctaactgacctcacaggaggctcataacaggaatgttatctgtcaggaactggttttcttaaaactgattttacctagcaagcaaagaatcactcatttttaaaaaaagggaacatcctgaggttgtaagaaagacagttatggcttcagattcagctcttggatttgcttgctatgtgatattgggtaagtcacttaacctttccgagcctcagtttactcatctgttcaatgggaaacattgctttcttgtaagcgtattattttaaaaataagtcttatatttgccaaaacaatgtgtacacattgctttattaaaaaatcaaagagtgttgaaagtcttaataaaagtcttttaataaaaaaaaaaaattcaactctcatcacccctgaatcttactccctggggtagctgctcccaactcctctggctgattattttaatattctacagatttaaatactgcagatttctccattcttagatccctccaccacctttttttttttttttttttttttttttttttttttttttaggttgcttgtttgggtctctctcttctgcattggaaatcctccccatggtctggtcagcttgaagatcaggactctaagaagccatttgtgagttccatgcacatggggtctggactgttgactgatgaaattccttgtaggatgatgaggcagtgagtcagcctattcattgggagctaccatatttcaggatcttgacgtcttttctcagggatatgtcagtttctccagataaaaatcctctaaacatttggatgagaagagagaagggctgaaaggctcaagtcttgactcatttctcttcccactgtctactgtctctgttgaccccttaagtcctgagtctttttggtttattacccacagaaatcccatttctgtgtggtgggggtgagaggagagaagggaggtagttgtctgactgtgtcaggggagggataggcccctgggagccacgagctctgcacacgttgctagatcccacctgctctcatcttgcgtatacctgggtgccttaacatgcctggaatctaactctttattctgtgacgtcacttgtcactacttctctcctttccactttcctctctccccttcttgctttattcctttctttcttcccttctccctcacttccttcccttgctcctttcttcctttcttcctgctaccttttcaatggagggaaatgagataaactcaacatgactctcagcttttcaccccttactttataaacagaagttctgttggaaggcctaattgagaggaaggatgaggaatctcttgctgaacatctggcataatatttatatgctcagttacacttatttctgcatcatgcctctcagcatcaccttggacattccctgacatgcccaaaggaaagaacgtgtggcctgagacataagatttttaggaaattcctagagctcagggtgcatcctccaagagagggtgggagggagggagggctctgaaatgccctctttctccaggtcagtcaattaattcaattaatcctcaagacaacttcattaggcagttgctatgatgatcatttccattttatgcccttggtcttcatatctatgcactgtattaccatggcctaggacagtcactcatttggggaagaaaaaggtgagaaatagcccttgaccttctgcctgtcaacagagtttaaaaaatacaaccatctttccctgtggaagccttcccaccagaacctacacatacatagaattatcctagcgtgatctcagacacagacacacacacacgcctgcgtgctccagaaagtggtaactaataagtgaaaccaaggttccgaggtctcctggtgcctgagctcccctgcagggctcccaatcaatacaaggtttgctgtctgcaacttggctgatttactaagattacaaatgaaaaccagcccccagagggtgcagcgttgctgtagcacagaaggaaagcgtaattcttgcttacactcggctttgtgatcggtttctcccctggtagctagtcttgtaacttctttttagagatgtcaatcttataaaaaacacacacacacagccccagacttctgcagatcaagactttctcatctcactggggtgttctctccccgctaaccacaggatactctgtttctctgtggctgtttcaaatggaacagctcttttggtagtttaaaaaatgtatattgaatagtgataataataactatcattattattgtgcttattgttatcatttctagttcctgtgtctaattctgtgtcagatgttgtgcaagacaccatgtagccaatatctctacaccttccccaacccacacagtttatgtataagtatcatttcctgacaaataaggaaactggggctcagagatggtaaacaacatcctcaaggtcacacagccagttaagagggattcaaacccagttaccctattgactgtggtagctctagaaccttcattcctaacactaagaaaggatttcaaatacagggtgactgccttaaaaaccaggctgtcggccggttgcggtggctcatacctgcaatctcatcactttgggaggccgaggcaggcagatcacgaggtcaggagttggagaccatcctgaccaacatggtgaaaccctgtctctactaaaaatacaaaaattagctgggcgtggtggcgggtgcctgtaatcccaactactccagagactgaggcaggagaattgcttgaacctgggaagtggaggctgcggtgaaccgagatgaggccatcacactccagcctgggcaacaactctatctcaaaaaaaaaaaaaaaccacaaacacacacacacacacacacacacacaaaaaaacaaacaaacaaaaaaaaaaaaccaggctgtctttctgggttctgttgatgaatctgcctcagagacaatacctggattccaacatattcctcggtttctggatccatcatcttcatagctaaaagaaaaaaaaaagccaactgccttcctcctgggaaatttacatctcttaaaagggtaacaaatatctcacattttccatctataatatgagccattgtcagagttctccttccatgggtccactttatgctccaatgacctcatagctccccagatgtacaatgtagggggcaagaaagcctggctctctccttaaactaaggttcgttagaagatccaaaaataaaacttttaggccagctcaggaggtgaggactaggctatcttgtcccccgccccactagagggaacacactggtgatctactttgaaaatcaggcaactggctcctgtaagtggcaggttttgtaagacatgcctcagcaaatccatctaattcatctgagaatgctcttagcttcaagtaatggaatggccaacaaatacgtccctccttcctcataaccagaaggctgctgaccttagttcagtggtctaatggcctgaggccagcatctctgtgattctcatggctttctcctcatggtctgctctcgttccaggcatcatgtccagaacctgggtaacataaaacaggaaatacatatgtgtgtgcctgtgtggatgtgtgtgataatatatagagtgatgaattcagggagtataccagatatagctgtccttttttgtttaaccaagaaaccaaaaacttctggaaacctctcccagcaaactgttatcatattcttggccatatctatgtcatataactactcttagctcccaagaaatctgggaaatcaggagttatagttaggtacatttctaccctgaataaaatgggatttttttaataaaaaagaagagtaaatcaatgtcaggtaaacatcctctgaatgatcagtgcaaatctgtttgggcaccctgaattccagttgtctccaagcatctcaggtgctccataaggacttcttcctatcaggataaacccccaattttccctcaggagttctcaaatatcaataatggtgaaggatagctgaggtacgcatgaattattcatcaaggtttttactctttgatttttctataggagttgatatacaatgtatctttgttaataactagaatctgatttgtgcatctgatggtttaaatattctgccttaggacataccaatcacccagcatgtaaatggagttcagccatatcctagtgggattagaggtagagaaacagccacatctcaaggagcccctcacatacatgttgattctaattcagtgtctgcctttcactctttgtccgcctggacccgtgtaacaggtctgctggaaatccttcatcccaaatactcagccagtgttgaacccagaactcttgctaaagtaaacaaggaaaatatggaaggggattttttaaataatcttggcatccaacaggctggggttggaatcttggctctgttgcttaattactttttgacactagtcagtttatctgacctctcaagacctcagtttccccaaatgagcagtaagaacatcaatatttacttcaaagagtgattttccaagttagataacatttttaacatatctagcatggtccctggcacatgatagacattaacgaaacattattcctattagcatccttttaagaaagcagagttgaaatataattgaaatgccaggggttcagtctaggtcctgctgctcatagcacagagagctaatcactgagacgatgagtattgccagggaagaaggctttatttgagtgctgcagccaaggaaacaggagattagtctcaaatccatcttcccaaccaggtaaaatagggctttatatagcagggaagaaatgtggggaaaataggaattagggaggagctagaaagaggtcaataggaagcaggtggtcattaggcactcatgacaggtgaggggtgtggcatcttattgtccagatgtggtgatctggtgagtttccgttccttgatactatctgggaagcctgatggtcagtttcctgagaaagaaactcagttaagataaatgtaagtttcaagctttaagactgtgagggacagacaaggtggctcacgcctgtaatctaaacaatttgggaggccgaggtgggtggatcacctgaggtcaggagtttgagaccagactgaccaacatggagaaacctcatctttactaaaaacacagtattagccagatgtggtggtgcatgcctgtataatcctagctactcgggaggctgaggcaggagaatcgcttgaacctgagaggcggaggttgcagtgagccaagatcatgccattgtactccagtctggggaacaagagcaaaactccatctcaaaaaaaattttaaaaataaaaaataaaaataaacaaaacaaaacaaaaaagattgtgagggtcaatttctatgtttattcaagaaaaaccaataacataaattctgcgggaccattgggctggtttcagtctctgctttctatttatcagttccttaattatggggaatctggtcattgatctttctgtctgctttatgctgagaaggggtgatgagaatttagaaggggctaagagccgacctactgacttacttctgggggctatttgtatgttcagcagggcaagaggcaagaccttttcccaggtaagatttgtctcttggcaaattttagaaagaagtttacaaaactgcttatgactcaaaggaatttcctttgccatttaagagatcacactctagcctgggagtcccagcttccaaggctccgaagctgagctgcatcttcagcactggcctaaatgggtgatctcttttgaagatctgtgtaaggacacctacaaccaccaaaaaataacattataactaatcttagcccttaaaaatcagtccttacattctgatgtgcccacctcttctgcaattgtctctaggcctggagggattgaatagtttttatttctggccctgtgtctcatgaaatcagttcattttgacggtcaccttctcctggtctgaaaatggggctttgattggtatcaatgttcaagatttagcagtagtcagtgcctttttcaggagtcaaagtcctgtaacttaatggcccaaggactttaaaagcaacacagaggccgggtgcaggggctcatgcctataatcccagcactttgggaggccaaggcaggtagatcacttgaggtcaggagttcgagagaagcctggtcaatatggcaaaatcccatctctgtcaaaaatacaaaaattagctgggcatggtggcacgtgcctgtggtcccagctactcgggaggctgaggcacaaaaactgcttgaactcaggagacaggttgcagtgagccaagatcacaccactgcactccagcccgggtgacagagcaagactctgtctcagaaaaaaaaaaaaaaaaaagaagtaatttagaaagttacatggatacaaaaccttaaatcttagtttttttaagcaatttgaaaaaaacaaaactaagaatgatgacataggaattatctaggtaaaacataaaaactggcctaaccagttaccaaaaggcaaagaaagaccttctgcagtgtgattgcttctccttatgaaaagcctacttagataacctgaaagtcaaatccaatgaacactttagacatatcaagaaaatccaaatgtacagaatcaaattatactgggggaaaacattatggttctagaccctcaagataaacatttcagcgtcaggcagttagacagcagcaggtagaaccagaggtaaaaagttacagtagctgacaaaaaagttgaaggagaaagttatcatctcagtccttttcaagtggaggaaaaaattgaaagccactagtaagacataatgaaattacacttctgaggtgggaatgtgagaagttttcaaaaagaaacagattatagaatcaaaatcaaaatctcttgtcaaatcagtctcttgtcaaatccccttgttctaacatagaggaccaatcttaactttttcatatctctctcctctatgtactggttcctttctaccttgtttataaataacctttctaagtccatgattttaatgaaactttaggtaacttctgaattttcgacaaaactattcttttttctcaataagagcacatcttctttggcacattttacagacagaattattatctattaactagagttcttattcttagtaaccttgaattccagtaaaaacctgaaaaacaaaaaaattctgaactatcagatattagcattttctagatgagaacatatcacaatttttaaaaacatattttcccatatcataaccctttcttaatcaatcagaaatgcctcccaacccatgagcatcattttttttttttaattttaagttctgggatacatgtgctgaaagtacagttttgttacatgggtatacatgtgccatggtggtttgctgcacctatcaacccgtcatctagattttaagccccacatgcattaagtatttgtcttaatgctctccctccccttttcccccacccccgacaggctccggtgtgtgatgttcccctccctgtgtccatgtgttctcattgctcaactcccacttatgagtgagaacatgtggtgttggttttctgttcctgtgttagtttgctgagaatgatggtttccagcttcatccatgttcctgcaaaggacatgaactcattcttttttatggctgcatagtattccatagtgtatatgtgccacattttctttgtccagtctatcactgatatttgctggaatgtgtgaagccattcctgctgtctggtacccacggaagacattcactcatccacacccagatgtcaaatttcaaaggctcttcttccttagcgattagtaacacagttggagcaggcagtggtggagccaaagagagagactaaaacccacctctgaccaaaaatggtcaagcagctgcttagaagtgcttccaaaacacttctagcccctgcagctgagccacaaacaacacgttcccagttgggcaaccaaaatctgttaccaaaatgccaggagtaccatctaggttctgttgctcaccgtacagaaagtcaattactgagacaacagatattgccaaggaagaaggctttaattgggtgctacagccaagaaataagaggtaagtctcaaatccatctccccaaccaactaaaattacaggtttatatagcagggaagaaatgtaactacatgtgggaaaataggaattagggagtggtaaggaagagaagctggttaacaggcagcaggggttcggttaggaaaacaagaattggggaggggtaaaaaagcaatcattggctgggtgaggtggctcatgtctgtaatcccagcactttgggaggccaaggcaggcagattacttgaggccaggagttcaagatcaccttggccaacatggtgaaaacccgtctctactacaaatacaaaaattagccagatgttgtgcctcagctactcaggaggctgaggcacgagaattgcttgaacctaggaggcagagattgcagtgagctaagatcacgccactgtactccagcctgggaaacataactagactctgtctcaaaaaaaaaaaaaaaaaaaaaaaaagaaagcaatcatgatgaagagtctagcatctcattgtccatatatagtgatctggtaagcctcagttccttgatactatctgtgagggatgacagctggtttcctgagaaacgaactcagataggacaaatgtaagtttcaagctttaagactgggagggtcaatgtccatgtttatatattaaaaaaaaaactataacatcaattctctaagacaaattggtcaggtttcagagggagattaagacattgaactctatttttttctttttcttttttatagaaaatctggcaaacccaagactcaaatttcagggaaataaaaaggtcttcggaattcactataactcaagttcaaatcccttctcttccatttggtagctgtggtaaccttggctaatttatttaaactctttgagtttctgtctctttgtatgtaaaacagggggaaataatacctgccttatttagttgactattcattccacaaacacacacaagtgcctactatgtgatagacacagggatacaaatattaacaagacagacatagttttttgttttttttttttctttgcttttgaaatttaaagtctagtggatgaatgttcggagtaactttaagcacttccaatttacagaaagtctactaggtgccggatcctttatttcgatattcacagcttccctaaaggtatgtggaacatcatccatttcacaggtgaagaaactgagtttggagaatttaaagaaatcacccaagagcacacaatgaatggccatgtcaaaatttgcactggggaccacgggacaacaaagcctttgataatgctgatctggatgaagcactgggcacaataatgggtgcatggaaaacgcaatctaattaaatgtgcttcagagaattgatactgcattatcactggaatctttggctaaacttgctaaactttggcaagtttagccaaagactccaacaatatcatgacaatagcactcacctcctcctgccttacagacataggtgcacacagagatttgctttcatcggtcttacagatgagttgcagaatagtcatgtaacagaatcaggcattatgtaatagcagaacaaacacaaatagcccatgagaccagcagcttggcataaattactaggagccatgaaaggcacagctgtatctaaagcatatgattacacagatgcacccatacacagagaacctatcaggaatgcatgatgactgtctttagagttccttaaattaggcacacaagaaaaatgagtctacaccctgccaagacaatgaatgatggtaataataacaattacatttattgaacaattaatatatatcagacatgttgctaagcaatttacattcattgcctcagtttcactttcaataatcctttgggttggatactataattatttgtattttacagttgaagaaactgaggctcagctgtccaagtgatacatttgataattgacagagctggggtttaaaagaaggtccacctgagcactatacttttaatgatatgtcattacaagcttgagcttcacttttatgtgtgaggacagacaagcctcaatattccccaaacctgtcatcattcaattcccatctccctactatgcatcttttgctcagttcttttctctgtctctgtcatcaatggacatatccccgaaaaagagcaacattcctgtaatgtgacccttgatcacgtgttcccaaaacatcttcaaactgtgcctggccttgtccacatctctacacctttgaagtcattcccttacagaggaatcagaggcatagagggcttctaaagacaagacaagacaagacaaaacaaaaaacagaaaaaacccaccttggttcaaatctaggcttcccttctccctgctatgtaaattggagcaagtcacttaacctctctgagccctagtgtctttatctgtacaatgaggatactagtacatatttcctaggaactctcattagaaataagtgaaaaattttatgcatgaaaatttgaaagatatggatgtgcctaacacacaataagcaaaataactgctattttccttctcttagttttgtatggagaacacatacttatctttgaaaactcagatcaaagcctcctccttttctcacacgtgggttttgtcactccatcctctgtgctctgggaactctgtgtctctaatcagcactttttacattgatttttatctgtttaccagactatctttactattagaaagcgagctcctccagggaaaaggctttgtcttatttctctgtgtatccacagagtctactgctgtcctaccactgtgtagaataaaccatcgtttgtcaattgctgcattaaattgcattaacactcacccataaaaccacctggagggggtgtgtcttggagagcagagctcactgttcttttgcttgtgttttgtgtattgtctcacatccagcataacaacatacagtaaatctgagagaaaccaagaataattgagcaatatagcttccttcttttgagcttctaccctatgctatgcactagctgttttacgtatatcatctctaattctcatagtgatcttgcaaggtcattgtgacttgaataagaggatgagatattaaattatgtttacagtcagtctcctccctactccctgcctgtaaaagggaaaagatcttggtccagctcatgagatcttccttactagaaagtataagccaatttgactgggccacggggtacccagacattcggtcaaagattattctgggtgtgcctgtgaggatgtttgtgaaggagattgatatttgagttggtggattgagtgaagtatctgccctctctagggtatacaggcttcatccaatccactgaagacttaaatagaaccaagaaactgaccctcttttaagtagaagggaactcctcttgcctggctgtttagagctgaaacactggccttttccggtcttcaggctcaagtggaaacatcagctcttcttgggtctcaagcctgccagctttcaggctacagtttataccatgggctctcctggatctccagtttgctgactacagaccataggacttgacagtctccaaaatcacatgagccaagtccttatagtggatacataggtaggtaggtaggtagatagagagacatagagacagatgacagagaggcagacagatggatagaaacacacacacacacacacacacacacacacacacacacacacacacacacctgtttctttttctctggagaatgctgactaatacaagcagaatccaaatagtgctaaaatggaggtgaaaatgaagaaatagaaatgtatttgatctatacgtaacaattttaaaaatgcaaaagcaggaagaaaagtgggaaaacagaagagcctaccagattatatatgaagcagcatttgggggcagtacagagaaagaggcgagagtttgcaaggaagcattcctaagaatgtaagagactggaagcagggaaatagagaaacttttcaagagatacataggacatcagaaatgattctttcctttgtcattttctcaagagtttgaagaaagctttgatttgtttttaacattttctgatgaaaatgagacattatataagacagggccacatagggtcctagttatgtgcagattacagttatacagattctcatacataagttacatgtgggttacagttatagagattctcatgtataagttcaacatttggggtgggttattggtttatgaaaatctctctctctctttccctctttccccttccctcctcatttctgtctccatctctctttctccctccctcctccccgatataaccaatttatttagctaaggatacagaaacctattgaatgcgaggtggccatataaaacaaaggccactgcaatgtgtctcattttagcttcccttggcccccagtgtctctgaaaggtacacatttacataaatgcaacaaatttagagagtcacatttttaccagtattcttgatttttgcttttttaattaatttttttaatttttgatttttgtatactcaaggtatgcattagaattgcacaaagactttcgctgacaagctatgtatttctatttaaaataagttctcctggttctcaaacccatattcggtattcacaagacccatgttcttaacagatgtaatgggggaaaaagcacgttccattcttaagtcagttcttagatgtccctgaaaaaaatatctgcccctagcactccagaaaactcatttccctgccaacaaagcttgcaacgttattattaaccatcaagatgttatcaaaatgccaggggttcagtctaggtcctgctacttgccacacagatagccaatcaatgagataacaagtattaccagggaagaaggctttaactgggtgctgcagctgaggagatgggtgatcagtctcaaatccatgtccccagctgaccagaagtgggggtttatatagcagggaaggaatgtagctacgtataagaaaacaggaattaggaattaagtagcggtaaggaagaggagtttgtcaacaggaagcaggtggttgattaggaaaacagaaattagggaggggtaaggaagcaatcatgatgaatgaagtgtttggcctctcattgtccagatacagtgatctgttaattttcaattccttgatactatctgggagacctgatggtcagtttcctgagaaaggaactcagataagataaatgtaaatttttcaagttttaagactagagggtcaatttttatagttattcgaaaaactgtaaacattagttctatgggatgattgggccagtttcaaagataacttaacttataaatatcagagacaaaatatgaatccggatctatctgactctaaagttcatgattttatactcttatctctgcagagcgagttcttagaaaataggcatcaaattatgccaatacaacttctatagaagagtgagtctgcaagccagttcagcactcaggagtttttttgtgccgtaaacagccacggccctcctctaagggctccaaacggagcacctggtatacctgtatggctagtccctagggcagtcagatcttttgaaatatggacctaatttaagcttggtcttttatcaaataactcacccgacaaattctcagttggcaaccaggaggcatgatatgagcttcggaaatttattatgaagaaaacaatagatcaggtaattcactgtctttggaggtttcatgtcagaggtttttcatcccaaattttactttattttgctctgaatagaagcaggcaattaaagatgtccagtcaaatttgtttttgagataaaaaagtgctaaggcagtatgggaatgttccaaagcactccaaatgtcaaataggaatggtcataaaaaggcaagttgaatgttaaagataagttgctgcaattggaatgccataaaatatgatagcctctttcaaaattttaacattcagacgggattagaacagcacagagcccttgagattttttccaacatcctcatctccagatctttcaaattgttgaaactaatgcacaacccagggcctgagaccaaatttctcaactctcaggccagtgaactcattcattaacttggaaagtaagagctaaatatttatgatggatgacttcatttctacccttatgtcaaatttcactgacaccactaaatatttcagaacacatgctcatcagaaaacttcccagcaccacgcacagggaagagtttaggaagggtcacaatatctaggcatattgtctacatctatgttttacctagagtgtgttcactgatgggacagagttaagtaacattgcatacttgcattgcatttcatttccttcttgaagattctcgattctcctcagctaattaaaagttcttagaagttcacctataaagagaatatttagcattctctaagtcattcaccctagtgatctggtagtactttacaaactaatcctgtcaaaacaactcctgaacccctccaaattcccaagcctatatctaaatttcttttttttttctgataaaaataaaattctttggcacctagaatataacattatttcctccatcccagataacaggatgctgctgggtcaaagtgggtgagcttcatagtttcattcttgcaagagaactggtcttgtaaatgcatatggggttagggagagcattgcattccaaggagtttcaactgttttttgaagcgaagaatgcagaactagtggggggaactaagaaaatgcaaatatagggttagaagtagaggaataaaggagtttctgaatatgtgcttagcattctgcatgattgactggatcaaagtttctcagatgccaatgtgcatcgaaatcacatggaggttttattaacacagagtttggggccccactcccagggttttcaactagaaaggtttgtgtggggcccaggaatatgcacttctaacaactttccaggttatgctgatgctgctgattcaggggccacactttaagaaccgctcttctagaccattggttagccttaaatatctggcataactactcagaccagcagtcttcaggtttcttcttagcataaaatctttttgtgcatgacatcattgttgttgtccgggtggtcttccgtcctcacccgacatccatggctacaccaggaaaccactcctcccacactgtcttggtgggaaactcagtcaagttatttccactctcacctggacagagtggatacctgacaaaagccatggaggggcccagctataatctaataccagcagtgagtatgggggtgggagtaagaagaagaggtgaggtagagatttcattgttgctagaaaatgagcaccaaaaaataagctatgataattggctccttttccatgcatctcaaggtcccattttttttcagcagctttcaatacagtctcatcacagacatcaatatattacttaattttaaaacgcattattttaagaatgagcccacttacccaacccagtcatacttctaagccaatcagactcctatgcctgggaatttgaattcctaaacaaattcctaacacaaagtccctaaaccactggagcccaaccctggcaccatgaaattttggtctattagttgctgctacgtggatccaggtgctgtccccagtcctatcttccagtattgtccagcttcccctttacttctctgtgtctcctcatttctctttactaagttcctttttcgcctaagtaagctaatctgtttctgtggcttaaacctaagattctcccaacaaaagaaataaggaactccatatttaacgcataaaaatagtatctctgaataaagaggggagtggggacctatgactgagacaactggaacctgtcacacgtgctcttccttcccaaagaacacctccaatgagtttctaaatagcctaaaagttttgggagacacaaatgggagatcttggcttataacatctacttgtgttttgggctcactttggcaaccagctaaagataagggtttgggtggatctggtcatcttaaaggccagtggataaaaatatagcccacttccctgcgagttttaattataaatccttgtattagctcattcccaaaaggccttggaaaagtgtatttgtgtataacacgatcctccggcacaccgggttgtattactcatttcatcagcatagatggaatccgatatttggctccactatcataacatacatccaagggcttatttcctccaaaagaagtacaattggaaatagcatcgattgagccaaaacatgttaatttcagcatatatcgttaaagagcaggcatcagcaaagatgcagcgttgaggaggcccacacaacagaaccatgagagtccttacaacacagccccaaatagaagctgcctcctggaggtctcaaacaagaaaagaaatccacatgaataagctttgtcttaaaaaaagagttttccatcctacaactttctttaaaggatagctcaactgaaagaagtcactgtctttggaaaacaaagccccttcaccaaatttagtacaattttacttctagagatggatgcttcatgatagagcataagggccccaggaaatccaaatcccacaagttgaggggcaaactgttctattcaggagactagacgttctgactttgagagtgctagacaagcctgttctctgtgatcattttgaataggaccctccgctcaaagggtgcggggtggggtcttagtctgattgctacatcagtccaatcaagaagctgggaggccaggcacggtgactcatacttttaatcccagaactttgggaggctgaggcaggcagatcactcgaagtcaggagttcaagaccagcctggctaacatggtgaaaccccgcctctaataataacacaaaaattagctgagcatggtggcaaatgcctgtaatcccagctactcgggaggctgaggcaggagaatcgcttgaaccagggagttggaggttgcagtgaactgagatcacacaactgcactccaccctgagcgacagagtgagactgtgtctcaaaagcaaaaaacgaagaagaagaagaaagatgaaaaaagaaagaagaagaagaagttggaacatagaccctctgaaggctaaccacttcatttacagagggaggactccaaaggccatatgaagtccacttagagatcagaatctcagaactagaaggccagataagtctatctgagagatacagccattaaacagagaaagagctagacaagctcatgaagggactcagatactcagggggcttatcagtcttttctaggaatggggagctgagaccaactggagaagttcaattatggttcaaaagaaaatattctctgctgaaaagttctcagctagggtcattaatctaagaaggaaagttaaggctgaaaggaattattaagcatgcattgcatgcttatttctagatgggaaaaccatttccagcccaggctgaagacaaaaacagaagacgatatttgagtcatattgagaagaagagtaggaatatggatacccaagaagtttgacaccctaagaaaaaaagacactgaactacccacctttgtcagcataacaccactgcttcttctgactttatcttagcctttgtccactcaattctcaaataatcactgaacatacgtatcccgagatgcccccacattttcctataaactgccctttttgcttagccttggtttctgttgcttacagccaaaaacctttaacagacacaatttcaagatcctaaaaataatcccctagctttcattatctcatcctcttcctcgttgctttaaaatgcctacaaacatgtgcagctccatttgaagaaataaaaattctctaattgcatttttgcacccagacatctgcatggtatttcacagttcgcacagtattttcatagcttcactaattggtgatccttaaatacttgtgaggttaaaaataaggaggtttgttggtgtcattatctcaattttacagataaaacagaaagtctgtgagattaattagcttgttccaggatctcatggctcacgtgctgtgcaaccatatttagagcaaggtgtatctgagtttgctccaagagtcctagattcgccattcttctttggaacctcttactttggtgtctcaaaaccttaattttccccccaacattgtatatccaggaatccaactaactggattctggcccatgaaagtacttggacttgagttgtgtgtgatcttaaataagttattatttctgttctgaattagattctgaacatatttttttaagaagcttcacagaacagactttttgttgttgcctttttttttttttttttgagatgaagtctcgctatgtcgcccaggctggagtgcaatggcgtgatctcagctcactgcaacctctgcctcccgggttcaagtggttctcctgcctcagcctcccgagtagctgggattataggtgctcaccaccacacccggctaatttttgtacttttagtagagacagggcttcaccatgttggacaggctgatctcgaactcctgacctcaggtgatccactcgcctcagcctcccagagtgctgggattacaggcgtgagccaccatgcctggccacagaacaggttttttatgcagtccaaacacaattatatgcaaggattcgtactgcacaacaaagcagtccacaatggaaggtcattcattgaccaccatccctccaatgggccaagtagattgagttttcataaaaggacatgctcactgcttaaatgtccattttttgtgcatcctttcccttaaaagagcaaagtgaaagattctgatattcctgatgtggcttagagaattcttaatcaaattctctaacccagatctgtactggacgtactctcaagaccatcttcctccttgagtaagaataaaacttaatacctggagtcacttaggtttgaaggatgagcaaatgtcattataaaaatgttatctacagaaggtaatgagtgcatggaaccatggtcggcttatcttcattgaattaacacattaacaaattcaaaaaagattcttagagaatgggacataggatacacaagctttgatggaaactaggtaaaagaatactgtctgtgttttactccctgagagagaggagaattccttacaatggaattccttacactggaccattgattaaaacccatgtatgtctagtgttccattactggaacgctaagcatgtgggagttatttatatcctactgctcaaggtcatcgctgaggtctgatttctcacacgtctgcaattcaaaaaaattgcaatctctggcataaatgggttaaacatatctgacacctaaatactgacagtcactcattatcggtgtggttatgggtgagttcctgagtttcttccattccaaaaaggaaataaaaatcttgcttcacctgcatctcaaggcttttgtggggacctgggaagacagagtaaccacgaggtcccagaaagatttattgggcacaaagtaagagaagtcagagataaagaagaaaacaaatttctcattcaagatggtatactggggaaaacactggaccattgatataaaaatactgaaagtcattcattatcagtatggttatgggtgagtcccttagtttcttccattgaaaaaaggaaataaaaattctgcttctcctgcatctcaaagcttttgtggggacctggtgagctaatggaagagggaatgctttgaaaagaattgtgattatttggatgtagaaggcaagatgcaggaggtgtcactgggtgacccccaagttcctgacttgacaaaacaggtagataagaaaagataccctggaagaaaaacacatttgagaagagagtttggtgggagttgagtatcctgtgttagtggaatacccaaatggagatgtacaataggcagctggatattcagaacacttgggccaggtgttctccagaactggtccaataaccagaaattccatccttctctcagctggagttactctgactgtgacagctgctgctccagttactctatttattgttactaatcccccagggccgcaagacccttccacagaactctctctcattcctttccacataaatcagcagaagaactacactaagtcccaggtgataaatgaaccccttccccaaagagtttggcttaagcccaaatcagcagcttgcctgtcgatttattgttcatttaaatcattcttgcctcttatgacaaaatgttaatgacaaaatataggtgatcctccaatggagggaaaagctgtatctttgcaactggaaattagaaatgtattattaacaatgagcattaattatatattttaatgctcacaggagagatgtgattgggggataatttgcagagaggcatagggggctctgaaacctagcgcgatcattttattagacagatcctattttctgcaaccatgaatatttcattcggaatatttactccatcttattattcagccattcttcctcggctaagccccagatttagacaagtcttctctctttcctgatcttgttcttgagagaccgacagttatccagagatgatgtatgattctgagaaagagtatcctgaaaaccaaattataatttgctctgtccccaggaaaatccgtattagcaatggaggccctgtgattacttagggctgtgcacactctatgggaaaaggatatgaggtatcttaagtgttgatatctcttgctctggaaagtcttcctaatcctaataatctaattctccagtccaagaccagatccagagtgcattgtcctgccccatcaaagacccccactaggttgtcctaattacctgtgaccaagacacacatccctctgcaaatgtgccaagcctagatttcaagaagtattcagctcatcagaactgaacattttaacaaatattcagatacataaacacccacaacctacacccttgcaaatatgatcaacttcatgggagtagatgtacttgcccagcatgcaagtaagtttacccctacttcaatgtatttcattaaatgaagtatctttccaccttttactgagtattatcttattccttcctcacaacctcacagcaacatactcttcattctgtgtactttgggtagaagtcaactgagcttcagagagaacatagaagcttaagaaataaactcttagctgggcacaggggctcctgcctataatcccaggactttgggaggctgaggcagatggatcacctgaggtcaggagttcaagaccagcctggccaatatggtgaaaccctgtctctactaaaaatacaaaaattagcagggtgtggtggcacacacctgtaatcccagctactcgggaggctgaggctgaggcagggagaatcgcttgaactcgggaggcatagattgcagtgagcctagattacgccttccagcctgggtgacagagtgagactctgtctcaaaataaataaataaataaataaataaataaataaataaataaaatgagcccttaagggcacatgctggtacatgctagaactgagtttaaactaaagaccaattctgaagtttatgtatgtaagatcatccaacccaccattgggtgaatttgagaaagttcaagaaaaaaaaacaaataaaaaataatgataaccctaattgtaaacaacagcaagtgccatttatttatgacatattaaaagctttgcacacattatttcatttagttctcccaacaatcatatcaagtaggtacagttatctgccttattttattgatgaaaaaagaatctcagaaggttaagcaacttgaccaggcacacacagcttctaagtgtgggatcagaagtcacatctctctgactccaaagcaggcaaattttcaccttggcattgaagcagttttacagacctatgttgacttttcttttcaccaattgaccagggaacttctaactactcagcattaaacttcctaaattattccattcctcctctgtcagactacgagctcaaagccttagtcctggaatccagttttctgccccaggctccctgggcctatgggtccagaggagctacctcttctccagtccaaaagagttccctgacttcggagtccagttctgtctgggtaaaacactctgctgaagaagggtccataagggattttactatggctatctttttggacatattaaggggcaagttctctaatgactcataaaggccattaacatgggttttgcagtgagtactaagaccttcccatatgagtataactgaaaccctacacaaataatgtaatgtttaattgcatgtgcaaataaaattgtgcaaaactctctaagagtataaagttcgaaagactgtattttataaagaattttttaatgatataggaacaaccttaggcaagtatgttaaggaaaaaacagcagggtgtgaaactgtacatagtgtatcatcatcattatgtaaattatctaaaagcgagaggtgggagcaggggaagtacttgcagataaatacacaaaagtgctaacaatggttgctgatagatggtatgatggagacttttaattttctttttttatatactgcgaaattttccaaattctcctcggcgaaaatatttgtctttggcctagggggaaataaacatttatgaacaacaacatgttaggttataatattcaaatttacatagaggtctaatattgtagatttgatagcaaacttcgtgaaaggagaataaagctttcaggttttgcttctgtatctattcaccccattagacgacattttgttgacataatattttctgtttgttcctttccttcaccgctgatgcagttagaatatctgtgttaaacaagcctacctgaggccaattacagctctccttccaaccctagaagacaggagaagagaagcatctcatttctctctcaccccatctgatacatatattcaggctgggcgcagatgacatctgtccagacaacggataatattgcaatcacttctgattagtttcctgttaccaccacgctgttcacctgtgttacaggagtggctactggggtgtgctggaaggagggaagagtaggcgatgaaggcagttactgtaatttgagaatctgtgctattgttaccaaagccgtttcttcagaatccagatccatgcatcctcctttcctcacatacagacattctgcatgtgggatatgctaggcaaccagtcaaatttcctatgtttcagtgggatggactgtttgtcttaatttacattgctccaggaccttaggagccatcatattggtgaagaataaataggtctcagcgattgtaacatgatgcatataatttgccactgacagtttttcccctgaaaatagcaatgaggaaaaaaacctagttacttctttcaagccagtggtgaactttctattcgttttctgagcaactcagttttttgagagtcactcttaattttgtattaataaaaacttgatttaaaaaatcaggaagatgtgttatgaaggctgtcaatccattttctaatgatccacatttcctttttcaaggccaaagctataactttaatattaaaatacatgttcactctaggccttaccaatgttgattaagccagggataaggcaagaagcagaaaagatcgacagtatattttcattcactctctcttaaaataatgatgcatgcaacttcatgtcattactttttaatgatcttagcctagttaatagcacagtaatattccaaaaaggagcaggaaattatttccacatttaattttcattgcaaaagtgagaggaactcttgatttttttttctgccagagaagctgtctgctgcctatgactgcattagctctgctacattacagctgagctaatggatcaaagccaagtgattactttcctagtcttttgagcatttccaagtaccaactgactggctctcaaagacttggacatggcttttcaatgtcgccatgaagtttgcttgatttcccatcaaggcagggccttttgaccttgcaactgacctgagatgggattcattatatgtgtccctttggatatcttggttgcacagaataattagaaaagggggctctaggaagtgtaatagaatattatacattatgatcctaggcctttggtatggagcagttaacatcacagagatggttccttatgttggagctcatggcagcaagatttaagatattacattttctcaattccataatgttcttcattataggaaacacaattgatatattgtatatatcaattcttctttttgggggaaaggagaaaaataaaaaacaacaaactaacttaaatcttgacataaattgtaaaatgcatctgagataacatcaaatgtgaaaaaaaataaaagtatgtctttgaaccacaataagaggccaccatatatccaacagaatggctaaaattaaaaagactgacaacaccaaacattggcaaggacacagagcaaacgtaattcacatacattgctgatggcagggtaaaattggccgaccactctggaaaaagttctgacagtttctcataaaatgaaacccacaactatcctatgactcagcagttccaatcttaggtacttatccaagagaaatgaaagcatgtgttcacagaagacttgtacctaaggaaaagttgtcagtagcaactatattcataataaccaaaggctaaaacagttgtgcatcaactgaggaacaataaacaaactgcaacatcttcattcaatgaagcacctttttttttttttttttttttgagacggagtcttgctctgtcacctaggctggagtgcagtggcacgatctcagctcactgcaatctccggcttctgagttcaagtgattatcctgcctcagcctcccaggtagctaggattataggagcttgccacaatgtccagctaattttttatttttagtagagatggggtttcaccgtgttggccaggctgctctcggactcctgatctcaggtgatccacctgcctcggcccgccaaagtgctgggattacaggcgtgagccactgtgcctggcctaatgaagcactattctgtaagctaaaggaacaaactactgacagacacagcatatagatggatctcagagacattatgctaagtgaaagaattcaaacacaagagtgcatattgtatgattccatttatagaaaactacaacaggcaaaactaacctctggtggaaaaaaagaacagttgttggttctggaggacaaaggatcagggcttgacaaggaagggtttcaaggaaactttagttaataacatacatgttgatgcctgcaacttactttgaaatacgtcaaaaatataagctggacggatggatggatggatgagtggatggatggagatagatgggtggatatgtgataaaacaagtacagtaaaatataattatagaaactagatggttggtatataggtgttcactgtaaaagtcaacctttctgcatggtgataattatgataataaagtgctgggaaagtatatctttgaatcaagtaagtatggtagatgaaatgtttcacccacatccttccctgtccccgttgtatggacttaaagaatccgtaatccctatggtgtgccttctgaaagctcacgattcttctatcttgttccattcaaaaatctgaaaaatcagcatgtgaacttgttccggttttatagtaggtagatgtgcgtgaccaatctcactttgggatatttgtattttaatccaataatgcatttaacactcactaagggttttgtttgtttggttggttggttttgttttttgagatggagtcttgctgtgtcacccaggctggagtgcagtggtgccatctcggctcactgcaacctctgcctcccaggttcaagtgattcttctgcctcagcctcctgagtagctaggactacaggtgcccgccaccatgcctggataacttttgtatttttagtggagatggggttttactatgttggccaggctggtctcaaactcctgaccttgtgatccatccaccttggcctcccaaagtgctgggattacaggcgtgagccactgtgcccagcattaagtatttttttttaagagacagggtctcactatgttgcccaggctagggtacagtggctattcagaggcaccatcatagcatactacagtcttgaactcctagacttaactcatgctcccacctccgcctcctgagtagctggggaagtgtctatttaattcctccagtgccttatctatttcctcacctttaaatatagtaacaaccatgttttgtgcaacttctgtgtgccagatactacgctaagtactttcataaattattgttattattgtaaactgtcttgcggtttaggagtcattaccactgctttacagatgagaaaactaaggtccaggcagtttggaaaattttcctaaggttagacagctattctgtggcaaagtcagcattcaaaatctggtgtgtctgattttgaagcccatgtccttcaacatacaataaaatgaggacttggactacggtcctttttggttctaaaatctctaattctgggagaggaggaaaatcactgtattagacactgttgagagcaatcattaaatttaagggtcttcgtataattttatgtcaataaataaatgaatatataccaaccgatttatagcattacctccagcgactcctgcaggctggttagtttcttgttcccccaacatcccttgtgtttttaaacataacaaaatgcaaagagaaaagacaatcagagatcagtctggaaaagagcacactgctgtcaccagctacctaacatcaactgattgctatagctcagggttgaatttgttgtttcctggaagccacagtgaagggcaaacatcttgtattctatagcatttgctttcatatacaagatagcatacaaatactactgcaggggtgaactttttttctttcttggacaacttggtaggaatctacattcttattcaaaaaatgttagttaacagggaacagtatctttggctttctttttttaaaacagaaatataagaaagcattcttcaaatggacaaaccttctgggatactccctaaaggcagcatatgcccttaaatagaaactcggctaaggccctgctgtgtggccgagaattagtttcacatgcttggttttgtgagaatctcataaaatattgatttagaacttggagactcaagataaatgactaagttaactggtcttttggttagatattgggctgcaattgattcatgactggtttctctaacataaattcatgggacagaaattgagttttgggttatagttcatacatttcttcctttgccattaaatgttgtgcatgttttcacctaaatgatcaattacattgtaacagtaaccccttattttatacagcattatgtagttatcaaagacctgtaactcttttgataacttctgtctctctctttctctctccaaactccctcatctctgtaggatagatactatgccctcctattttattttatagattagtaaatagaagaaaagagataatagtcactattatttcattttacagacaagaaagttgaaggaaagaaatctggcaaaaattacatacttgatagttgcggcagccaggactgaccctgccttacctctgtttgaacagcaatagcaataacgatagtcataaaacatcacagcttttatgtagcaagatgctttgcatgcatacgtcagtgattctccagtccactaagagattggaagactccctagctgagcaggtccctctgctggaggattcagggaaccaaagcctatcccaaattggctgccatcttgacaatttctccccatcgcccactgccatcatggcagcacgcactaaaccagagaagcttctacatggattggttaaattctgggcttcctaaaatgttccagaggctgcttgcaatggggaagtcacagaggagtaactgagcctatcattcttggccaagtcctgcaattatggctcacaattatttaggctcacctctttctgatatctgcttggtccttccttatttaagatgcacaggtggggtttccagatggtctgggggacactcattctttatttatcctcttcgtttgccttataagtaaaggaaacttgagattataataaatgctcaataaacattatacccgttctgggttatcagaaaaacaatgctaatatgccccatattagggtttatgagctgtagacatgttctcaccaaaaccaaatgagacctggttcactgtaatgctcccatccagcaaaagccaccacacacacccgagctccctaatccagcttggagagtctcccaactggctacaaactaatcagaaaatataatgactttgtacgtaatcaaacagtacaagaacacttcttttgttgaatggcacataattccacagacttccatgtgctcatatatgaccgagggctaaatatctacaggctaccaaaggtgtaattaaggataatagacactggtactcatgaactaaaatcactgcattcctaaagattactgaagattctaattcaatgtttttcaaagaatgattggactatgcaggatcccttatgctccttctcaaatgcagtttaggagtctgtagtgctgagagggtcatgctcaaaaatatttaagataccacaaatgagccaaacaaaaaaaaagaacaaaataggatgttgagactgaccatccgaagcttcaccttgcccattatcacatgacctgcttctctcctcctgagctctttattttctgattgttaccaactaacctttctagtagacaggtaaaaataatacccttccaaagatgttgcagtatagttcttggtctctttaccggagtgttgttaattacacattaaccacatgaagacttgggatggaggagggaggagttcttgcagcctgtggaaggggagcctacagcacatcaattaccaaccttaaggactgttcattaagtgagatgatttatataaaacaactatcacataataaatgctcaataaacattatacccattcagtacctcttcctggggaatataatccattttctacctgctgattaattagcgagagtcctgcatatctgagtgatgcgccatacagagcatggacagttgattcatcatgaataatgtaatgtcacaatctggactatttatattcaggtgaattgtacataatatgccatacatgctaaagaggaacattaatatttagcattccaagctaagccaggatgattaatttggttttaacttagtatcttctttgcagaattttcaatcctctttctctttttaaagggacattataagaaatattttctacaacataattggttcttgcttatacactgcttaaaagagttgtgtgggatgtttcgagagccttaaaaaatctccagctagctttttatccagatgttttagttctgagactttatgctaaggagacatttgaaagtatatgaggaaaaagactatgcaagaatgtataagaacaggtaattgcttcagtaaattcattcattatatggaacattatgcagtcattaaaaaatgacttacacaaagcattatcaacaacacaggaaaaggaatatacttaggttatagatttcagtaaaaataattagcatacagtaaggaactgaagaaaatacagcaaaatgtttacagtggtcatttttgaagaagtgagtctactgataataccttttgctacttcaaaaaaatttccccatttgcttttttaattggaaaaattcctttacatgtaagttaaatattactggctccaagctccatgaggccagagtctttgttcctcattcactattatggttccaagtcttaacatagggcttgtagtaatttttatcaaccttattttctgcaataataatttctctgtttttttttaaaatttttgctgagttcctgaagccaaggaaattaatgatgtggaagagagggataatggtcaccagtcaccatttattgaccacctactatgtgcccgcccctgtgctatcctctctacacatgttatttctaatccttgtcacagccttgtaagtaaatatgatctgtatgtttcagatatggaaacagaggcacacagagaaagctaaggaacttctccaagttctacttagtatgaataaaactcaactgtgtgattctagtgttttcactgtttctactagagctcacctggcctttagatctttctagaattccataagcagatgctgtctcaacacaaagataatgaccttttcagttttcattgcagatgttcctgagtgattactgcttctattggtttacacacggcatgcgtctatgcatttaaaattgtgcacctaatgacccaggatgccttcctatcatccatcctgctctccagctccacttggattcctttactgaagccccagcacttggtcttcttgagtcccttgacctctcagcaaggtgagagtgggtagccatgtgcttgaccgtctgggcacacgaacgcagcaccaagaaggcagatgttgatgtttactacagaatctgtgatgagcattgctgggcctttggatttgcggagtgcgcagtttaaaatcacactcaccttcaaggagccttccttctttctgcaaataacttgtggagggctcactctgcacagcatagtgctgagtgctagagtctaagatggataaaaatatttaagatccctgtctgtctggggctcgcaccccactgggagaggtagagtcacacatgcaagtacataaatggctatgtgctataataaggaagctgggtgttgtgatggggccccttccgtggtctgaaggccatttaggatgtaccagtgctctgaaatataaagaatgggtagagatgaacttagacaagagggtggggagggaagcaacacgactcatttcaaaaataaaaatggttagaatttcccagagcacataagagctagtgagagaaaagacccaagaaaggagaagcctgatgcagaatcctaaagactgtgctaagaatgttcacatttatggcaaatgccatgggaggctattaagactctaaggaggctcaaattacatttttaaaagatccctctgatggtgtgggagatgagctggagagggacgagagtggatgtaagctcctcctttcttccctggtccaaagcagcatctctcgattcatcacacctaccttggatacagcctctgtgacggagtcttctctgcacctctgcaaatctatcttaggtacccctcatatgctccatggcactgtgtactttctccatcttcacacatgtcacagtatattggaattgcctgtttacttctctgtaacatcactagtctgaaagctttgaaggcaaggatcacatttatcttgtttacacttacatccccaatgccaccaaccatgttggttcacagtaggcattcaacaaatatttacacaatcaccatttcattgagcacctactgtgtgcaaggtacccttctagtcctttcatacgcatgaactcacccaattctgccaatactcctttgcagcatgttctatgattgtccccaaggtaaccgatgagtaaactgaggcacagaggaggctaggcaatgtgtccaaggttacaggctagtatgctgcaccactggggttcatagtgcatgcttacaaccacacactctaatgattaacaaaagaatggaattctcatctgttagagccagcatttaattatctgtgttaatggttcaaggcagtgtcctgcatcatccaaaacagtgagtaacttccaaataatccccagcggactctatgatacatatgggctttttttcagtagattgaccttcataaattaccacttaaaatagccaataacaaaacctattcctgttccctaagtagcaatcaaactaatggacaggaagtaactaagaactaaactggctaagccaaaaaaagcactcaatcaacaaatttaattaagcacttacttgttcttcttcaggatcctgccatggttcctgtttcttatcgctgccaagtctcttaaaagcatatgctacacccaccatctctatctacttccttacctcttctttctgcatccttaaatcaggtctttgtttgcacaactgcactgaagtggctctggcaaaagtcaccgatagccactgtgttgccacattcaatgggtcccttcatctccacagctgtccatggcatttagtcttctgtgacatctttcactccttgaaattttttctttagcaccttggataccactgcccatcccaggagaaacagacgaaaggacagggatccagagcaccctattttatttctcatctctctgtgaccgggaaaaatcacaaactcttcctctgccctgagttttaacccattgtgtgctgctatgagattaagacatccaggctctgtggctttcttttttctcccctaatcttacaggacagcacaaagaattttcataaggcagtatttcacatcaattagaaaatatttgaatcaacaaaacctccataatacagtatactgaatatatgaatccaccaaggaaattgagtttgttttgttttgtgttctagcaagggatttcatttaaggacatgagaggtacagagtttcaaagaagagggcagtcccaggatcatccaggctaggagggccctataactacatttaaacattgtgcaaaggtacaaagggcttgggctttgagatcagcaacttgggctagaactccaggtcagcaaattcctaagagtataaatttctgcacttacacttaagctcttgagactcgatgtctttatgtggaaaataagaatgatagaagagatagtgaagaacaaatggaacatataagctcttagtaagtgctcattttctctctttccctggtagagatgtagcttccccacatttgccagctcctttcaaggtgagtagggctgtgtgactggtaccatccaatcaattgcgagtatataggaagctcttagtaagtgctcactttctctctttccctggtagagttgtaccttccccacatttcccagctcttttcaaggttgggtggggccgtgtgactagtaccgcccaatcaattgtgagtagaagtcttccgtgtcacttctggctaatgcgttcatgagccactgcaagaccctccaacagtcccttttgttgtggcagcaacctggaagccatgtgatcaaagcagcttacatttctgagtcatcacctaaaagacggtcctatagagttgcctaaccagctttggaatttgcgtgagtgatacgtaagcctttgtcatgctaaaccactaacatttctgggttagtctgttcttacagcacagcctagattaccctgattaaacgcatcacccactggggagtccttgtgttcccaggggtggaagcaaggatgaatcagcttcatctctttttttagccaaggtctttactgatagcatctcctgttttcttccttctcttcccttcacacaccagaatcggatctctttattttacccccaaagaaactgaagtccagagaggccaagtgacttgtccaagctcacacagcacataagtggcacagccaggccaagaacccagggcctccgactcccctccagccctcgtagtgtccacactacactacctcccagcagcttccagcttcaaatgttaataatgttctgagcttgccatacctttcaatcactgtaagcgatacaatctatgctaccttaatgcactaattaccaaaggagcacattaccatgccctaattactaacaagaagtgttgtcaattcaccatcctgtttgccagtacatgcaaaatgtttccagacttgttctcaaggtttggctggaggagggaagacaaaatacaaagaacaattgattcatttcatattgacaaccagtcaggtggcccttctattattattctttgttacctaaacacaatccaacaaagccccagaagaaaggtagctgatagaatgagatgggtgggacaggcagtgtaatgagctccagaaagagatttgcccacctggtttagatgcccatctttccctttttgcctctagggtttttcaaagcctctgttttttcagtcataaaatgggtataaaagtagtgccaacctcatggggctgccctgggaattcagtagcatcacgcacacaaagtcctatgcaaaatggcaagaagataataagatgcttaactgttattgcctatgatgatgattgctatttaggggtagtttcttaatcactgatttttccaagaagattaaaaccaggcaacgaggccaggcacagtggctcatgcctgtaatcccagcactttggaaggccaaagtgagcagatcacttgaggtcaggagttcgagaccagcctgaccaacatggtgaaaccccatctctactaaaaatataaaaattagccaggcatactgctgggcacctgtaatcccagctacttgggaggctgaggcaggagaatctcctgaacccgggaggcagaggttgcgtgagccaagatcacgccactgcactccagcctgggcaacaaagtgagactctgcctcaaaaagaaaacaaacaaactgggcaacgaagtaaggataagggaccctgatttatcttttattaagcacttgcccattctatgatgtgacttcttggtaggtacattgctaacattctgtcttttaatctttattcccgtcctataaattagatatgattgtcagttttacagatgaggaaactctggctcagagatgttcagtaacttgtctgaggccacacagctagtaagtagtagacgcaggatttcaatccagggctacgtgcctttttttttttttttttcatttcacaacaatactgtaattcaatttcacttttcgtggactgtctgcctccacgcatctttatggaactatattttggaaactttaaagggactatgacttgagggcaaaggaatgagcacatcttctgggaccgccatttgggacataatcatatgcatttatagagcctttgctgtgtacctagcacagtgtttagtgctggggtcatagggatcaataagatgtagccctggctttcaaggcgttcaaggtttaacaagaaaactcgtacaaatttgagtcaattacaataacctgtggccgatatgcaacaaaactataagagcacagaggagagatggaactcaggagggacttagaagaagcaaaatctaaagcaggttttgaaaaattaaacaccacttgcgtgcggtttcagggagaaagggcattgcaggtgcaaagcagcagtgtgcaaaggcatgaggtgtgaacaagcaggctgtcctcaagaaagacaagcagccattctgctggactatacaaagcatgagaaggaagaggagcaatggggctccagaggccagctagtgtcaggtcactagggaccttgcactccacgctgaaggcacccagaagcagtcttggtttctaagccggggatggcacagtcaggcgggctttatcatagaccctgctgtttgctacgcaaagccagtgctggctgccaactctggctgcgcaggagactcaccagggagcaatttttaaaaatccagtgccaggacctcaccctggaccaattgaatcaggcactctggaagcgcagtctggacaccggtatattttaaaagctcatcggacaatcctaatatactgccaggaatcacgctactggtgtaggggcagaaatagcatccaggaggctagtgctggggaaatgaattctggatgaagagaaaggacaagattcaaaacaacaatattttaggagctaaaattgacaattgtgtttgatgagatgtgggagctgagaaagaagaggagggagggtgggtaggaagtgacgctccatttttttaatcttgatacataaatatattatgtgttatacacctcacataatattagtgccagagagtctaacaagcccatcagcaattattgatgtctcctcatccccgtactggttgtctatgagagttcaaaaatactacaatgattgaagaatgcgtatcacatcctacaagcaccatcttccatactcaggggtccacattcattccagtcaccctgcacggtccagagggatttgccttgaacccatcctggcctcttgaaggagaaatgcctggggaattccacaggaggaatgaaattgctgtctcgttagtgcattatttactttgatgcacaattctagcagttgcagttcaggctctattgttcacatggttgggcaggaagtgtaatgggaataccattaatctgatggttttaaaggaggtgatttccaattagaattattctcaagttgtgaaatgagtctgagccggtttgtaaaacagcgagtaatcaatgcactgtataaccttgattttttagagtcccaacgctatgcagaaaaaagtgtcctccgaacccattataagagggtaaaaaaaaaatgccatcatcctcccaccccccagacaaattagcaagaaaaatgttagcaaaaagctctgcagacgcaccattatttacaaaagggagagagaagaagatgctatgaaataaatcatgctgacagttcaatcaaaaaaaatcagaatatattattcatgctgtgtttcatgagttggaaaggaactggacagggagagccaaatatgtagttgtgtgctttatttatgcataataatttgaattcctaagttacctctgtttaatgaaatctgcgtgctaactgacctgacaggctcattcaacatgtattttttgaacttcgactcttaactagtgctggtctagatactggggatgcacaggtgagcaaaccaggtgagatctctgttcctgggaaggttagttctgcttgtgagtggggtggatgggcagacaataaacacgcaaacaagaggacagaggttcataatcggtgcccaagaaaaaagcaagcaggtggtgcaatagagacctgccacgggctactttgtactggtgattgggtgaggcctctctgcagagatgatatttaattctgtgacatgcaggagccattaaaagagaatcgagagaaaacgtactctggggacggatcctaccaaggccaagatgtgggagtaagaacaggttgggtgtgtccagtcaacacgcagtaggtgcatggactgcgatacagtgagctagcaggggcaggtaggagatgaggtccgagaagtaggcagagctttgcccaggcaagactttgtaggctgcaggaaggagtttggattttattctaactgcaatggaagccaaccagagcgttttttttttgttttgttttgttttttgagacggagtcttgctctgtcgcccaggctggagtgcagtggcgcgatctaggctcactgcaagcctcgcctcctgggttcacccgccattctcctgcctcagcctcctgagtagctgggactacaggcgcccaccaccatacccggctaatttttgtatttttagtagagacagggtttcaccgtgttaatcaggatggtcttgatctcctgatctcgtgatccgcctgccttggcctcccaaagtgctgggattacaggcatgacccaccgcgcctggccgccaaccaaagtggtttaaggggaggggtgataggatctgactacaagactcctgtggctaggttgatgattcagcactgtgctggactccatgagggatgacagggagagagcagtagtaaccagtgggtggggaggcatggaaacttgagtgggcttgggagtgacagtagggttatcagctaaataatcgaattgaagataaggaaatcttccagaaggatgagctatttgaagacatccatggtgagaggcaggagcaaacagtgggaagtttgctgagtatatttaagtcatcaacactaacacatttgaagaaagatggtattatgtgggttgccttgcccagagagcaggatgtggaagggcaaatgtgggcaggagagggtgtgataaatctcagaaccatgagaaacctagttactagagatgagacagaagagggatggtgggcccaattctggagtgatgattctcaactgggggcaattctgcatctcaggggacattaagaagcacctggagacatttctggttgtcacaacttgagaggcagcgctactggtatttagtggataaaggccagggatgttgctaaacaccctacaaggcttaggacccccctcacaacagagaattctctagctcaaaatgtccgtagtgccaaggctgagaaactgtggatggacagcagagtagaacaatcctggatttcagtccccagtgtgtgaacttgagtcaagtttttaacctccctgagcctcactgactccatctgtaaaacggaggtggcaatcatacctgccacccgtgggggtgtgcatagagctgaggcaattgaggtaataaccacacttgcaggtgcagcgggactgggaagaaggcagaggctatgccatatgcctggtaagtgtgagaggtggggccattctctgaattgggcatcagaggattggggtttgagttctcttgcacacagtgggtggacttttgggaagtgactcagccttcctatgccctccctattctggtgacagatatagttataaatatagatatagatatggatatacagacatacctgctctcaatacagaagcataaaaatcatgtttatgtggcccatcccgtagaggatagtctagtctgttcaggctgttataacaaaataccacagaccagataatttataaaaaacagatggccaggtgtggtggctcatgactgtggtcacaacaatttgagaggctgaaacaagaggagtgcttgagcctaggaattcaagaccagcctgggcaacacaacgagaccccatctcttcaaaaaaatttaaaaaaaaattagctgggcacggtggtgtatgtctgtggttccaggtactctggaggctaaggcaggagaacaacttgagcctgggagattgaggcccaggttctttggaggctaaggcaggagaatcacttgagcccaggagatcgaggctgtggtgagccatgattgcacccctgcactccagcctgggcgaaagagtgagggaccatgtctcaaaaacaaatacataaacaacagaaatgtagttctcaccattctggatgctgggaagtacaagatcaagtcaccagcagatttggtctcagctgggcggtccagcttctaggtcatagacggccaccttcttgatgttttttttcacatggtggaaggagcaagggagctctctgggtcctcttttataagggcaccaatatgattcatggaggctccaccctcatgacctcatcacctcctcaaagcccttccaatactatcacactggggattaggtttcaacaaatgaatttcagggggacacacatgtaatcccagcactttcggaggcagaggtggatggaccacttgaagtcaggagttagagaacagcctgaccaacatggagaaacccccatctctactaaaaatacaaaaattagctcgatgtggtggtggttgcctataatcccagctactcgggaggctgaggcaggagaattgcttcaacctgggagacagaggttgcagtgagccaagatcacgccactccactccaacctgggtgacagagcaagactctgtcttaaaaaaaaaagaatgtcaggggcacataagctttcagaccacagcacacccttttccaggttccatcctgtaaggtgggacagggcagagtgcaggcacaacaaacagcatgcccagtctcagcagaactgcctttctcgcacacagcatgtgggcccacttgtcccagatggctctccttagtaccacctgaacgcagctttatttaactcaacactagagagatggtcaaaaagaatcagccgtgagtgtctcacctagcacgaagtctcccagcctcagcatggtcgactctttggactggataattacctgttgcaggggtctgtcctctgcatttcaggatacgtagcatccctggcctctacccactacatttaagtaatgccaagttgagaaccactgaactagcatggtgtagtaataactcatcatcatcatcatcatcatcatcatcacctgtgtagatggacagaagtcagactcaaatcccaccgcttccccttactagctgtatggccttaagtaagccacagcattgctctaggattctgttttctcatctgtaatatgggtataacactttcctatgccgagaatgaagtaatgtataaaattcttagcacagtgtctagcacacaattgttctccaaaaagtccttatccttctttattgtacatgattgagagttacacagagttaggtcgggctcggcggctcacacctataatcccagcactttgggaggccaaggtgggtgggccacttgaggccaagatttcaagaccagcctggccaacagagtgaaaccccatctctcctaaaaatacaaaaattagctgggcgtggtggcatgtacctgtagtcccagctacttgggaggcagaggtggatggaccacttgaggtcaggagttcgagaacagcctgaccaacacggagaaacccccatctctactaaaaatacaaaagttagttcgatgtggcggtgggcgcctgtaatcccagctacttgggaggctgaagcatgagaattgcttgaacctgggaggcagaggttgcagtgagctgaaattgtgccactgcactccagccggggtgacagagtgagactccatctcaaaaaaataaaaaaataaaaaataaagagttacacagagtcaagacagatctctgtggctgggtccccagaacaaagtcctcctatccccttaaacagggccacagatggacagtgagtatatggtccaaggcttctttaaacctgccccgtgaacacttgctccctcatctatctacagagtggctgttattatttatgaacaccaccgtcatcatcattagcaaaataagaaactgttggattttcccccatatctagaggctgtcttgaccctatccagactcaaggacccccgaactttctgatcttccccctcagagggaggaaagccactaaaatgaagttcttataaggtcgaccgatgcacaccaagaaaaatcagcattgcagcaggccggggtagggcgtgggtggtctccctgacagcttgtttttaaatacttccaaacgaaaatgagtttgcctccaaggaactgcctgtgtgctggcagatccgaaagcggaagcaaagccctcatggctggctgcatgcaggcatcctgatgcggaagtgctgctaatttaaacccattttccaaggtgcccacagcctccatggggaatcaccaacactctctggagaagacgcttaatcacctgaagaagtcatgggaacagagaaaacaagagctgaaaaccctctccgaaagggaggcccccaagtgacattttcagcagaatattattctctaagcattgtcttttcatcctgtgctctcttgaaccaaatagatgattaggatttaagatgcatttgatgatattttcctggtagggagccagttgtgcccccagttctgtcccaccttttaatcttcttggtggagttcccgaaggaaatggaagtgaagaacttcagccaaatgcaagcaaacaccgcttcgttattagctgggccaatgcccaatagcccgatgttggacgatttggaaaaagctggtctatgcagcagacacttgataggtaccttcttcttaacctagatcagaatcttgagtgggtgcagcgataaaggaactctggatgaaagaggcgcagctgatacaactcaggagatagatcaccacgtgcataacggggaaggaggacagggagggagggagaggatatggctggtccagctcacctcatgcactgtcacaggtgcatggacagaacacgacagagggagattagcttggtacacgtctcttagaacacagcgaccctggccccaatcagtgtggcccaatccagggtttatactctgactaatcacattagcctcttcttctcccttggacgtgggagctagggtgaggatgcactgagcacgcttgcacacatgggacaccaaggccaatgagagactgaaaatgagtgtacctccaaggaactgcctgtgtgctggcagatccaaaagcggaagcaaagccctcgtggctggctgcatgcaggcatcctgatgcagaagtgctgctaatttaaacccattttccaaggtgcccacagcctccacagggaatcaccaccactctctggagaagacgcttaatcaccctgctatacatggagctctattttttttttttttgtttttgagatagagtcttgctctgtcacccaggctggagtgcagtggcgcgatctcagatcactgcaacctccatctcccgggttcaagcgattctcctacctcagactcctgagtagctgggaccaaaggtgtgcaccaccatgcctggctaatttttgtattttcagtaaagacagagtttcaccatgttggccaggatggtctcaaactcctgacctcgggtgatccacccaccttggcctctcaaagtgctgggattacaggcgagagctaccacacctggctcatggagctctatttatcaaggatttttccttgtgatacaaaataaaattggtcttcgtatccccactgccaaacactgggaatgggtacagaggaagtaagttcctgacctagcaaatatttcttcattcccttgtccttttatccactgtagcacaaaatagcttccttggccacccgtgtgagtcaactcttgtcctaggaccaggtatgtgtatgaactaaggtcagatctggatgggcaaaaaccatcccagcctccttccctcctgcccagtgacctttctccagccttttctggcaggctccgtcaattgttgattcatctcctgtcatcttctccatgcaacttagcaaaatattcattcattcagtgaatatttattatatgccttcatcttaggttggatttctccaagcagtggctgagagggtgatgtgggggcaggtgatctatcaagaaacagtgggccaggcacggtggcccatgcctgtaatcccaacactttgggaggccaaggtgagcagatcactgaggtcagaagctccagacaagcctggccaacatgatgaaaccctgtttctaataaaaatacaaaaattagctggcatagtggcacatgccggtaatctcagctactcgagaggctgaggcaggagaattgcttgcacctgagaggcagaggctgcagtaagccgagattggaattgacccttgcacctgaaattgatcgcttgcagctgaaacgcagaggatgcagtgagccaacattgaaattgaccctctcattcttaaagcttgaaacttatgtttgtcttatctgacttcctttgttaggaaacaaccttcaggccctcaggataatatcaagagaccgcaactgggaggccaaggcaggaggattgtttgaggccagaagtttgaggacagccctggtaacatggtaagacccctatccctaccaaaaaataaaaaaaaattagaaaattagctgggcttgatggtgcacacctatagtcccagccactcaagaggataaggcaaggatctcttgagcctaggagtttgagggtgcagtaagctatgattacatcactgcactccagcctgggtgacaaagtgagaccctgcttcgaagaacctggaattccacttctttaccccttcctaagttctgttttcctgcgtgtagctgcattccttcccagctatataaacccccaattttagtcagatggggagacagatttgagacttatctcccatctcctcagctgcacacctgaataaggccttttttcttggcaatacttgctgtctgagtgactggctttctgtgcagcgagccgtgcgacctacacctaacccttggcatttcagtaacaaaagctcttcaagaaaaacctctcaaggaaggacagtggaataaggcgaaggaaagaccagagagcaagaacatggtccaggtagagtctagccttcgccagatccccatgggcaggtctctagcacaggggttgacaggtttttttctgtaaagggataaataataactaattgagcatttgcagtcatatgatctctgccacaaccactcaactctgccactgcagtgctaaagcagccacagatgatacataagtgagtgagcatggccatgaggctaaggaacttgtctgtctcgcccatcaatgtgccccatgtctggaacacggtaggcaggaataaatgatgttactgcacatccaggcccctctactgggctgctgcatccatgatccagctgccataaatgttggctgatatggcttggagatgcccttctgatacagaaaattgcccacagctgacagaaaccaccttgcaaaaaagactacgctccaccctccaaccttcccagaagcagcccacagccaatggctgatggatatataagggcacaagagaccaaccctcctgcttcatggagggacacttcagtagtatgataccttctctaaagttgaggtcagcaaattatggactgtaggccaaataggacccactggccattcaactctgaattcgctctactgagcacagaccctggaagagagcagtcagagagtaaatgtttatcgaatacaatggaataaaattgaaccttgaaagacgggtccaatttgggcagggtggggagagaaaagcattctttcaggtcctcgaacatgttatacacgctgttccatctgccaccagcactagcctacctcccccacaccactttgcctagccaaccagcattgtctctcatctttcaagtctcaagttagatagatctgcccccagcatgagtccattgctccccatctgttctcctacagtacctttgcttgctactcatggaataattctcccatcgtgtatgaggtccttaagttaatttctctgtctcccgcactagaatgttggcttcttggagtcagagacctcacctgtctcagactcttccatggtcttagcatctcacacagtgcctggcacgtggtaagccttcaatataatatttcagcaattccactactgagtatatagccaagagaaataaaatcagtatgttgaacagatatctgtacccccatgttcactgaaacgttattcacagtaaccaaaatatataattaacctaagtgtcccctaaaggatgaatgaataaagacagcatggtagatacacaaaatgaaatactattcgccttaaaaagaaggaaatgttgtcatttatgacatggatgtacttagaggaaattatgttaaatgaaataacccaagtgcagaaagacagatatctcacgatcccacttatatgtggaatctaaaaaagttgaccttgtagaagcagagggtaggagactgtttaccaggagctgtgaagggggtggtatgggattggggaaatgttggttaaagatataaaatttcagttagacaggatgaatacattcaggagatctactgtgcagcaaggtgactatatttaatgacaatgtactgaatacttgaaaattgctaagagagttgattttaagtgttatcaccgtaaaaaatatatgaggtgatacatttaattagcttgatttagccattcctcaatgtattcatatatataaacatcctgttgtataccataaatatatacactttttatttgtcaactaaaaacagaaattattttgactctagatttcttttcatccaagttttattacaaaattttccaaacgtgcaaaaaagttgaaaggtttagtacagtgaacaccacttagattcaataactgttcatatcttacagcctatatattttaaataatagccatcattcttgggcatttactgtatgtcaagcacctgctaggtgatttgcaaatatcatttttaaaatcctgaaaaatagcatagaagataagcactattattctcccccattttgctgctgagtaaactgagacttagagaagttacatcactaaaatcaaacaggtactaagtgttagatttaaaccggatctggagtactgtagctgaattccggactactgcgttatagcacagtgtgtaaccccacaacgatatgatgtgctaggggatcctagaattgtggggctgggttatttctgaagagtctgaggcagctcctgcggggagatgactccagagagcaactgaaagggagatggagctgagacaagaaatccactgctgaagtttggtggccgatcatcaaagagattaactccaacagcatctaccccaacccctttcttccttgccatacatctctgacactaccattattagtgactgggctcagaagcttgccaccttgtatgatctgaattgatccagtaaagaattctctgaaaagcaccattaagatgatttatagtctaattttggttgctatagattccaagtcagacttatgactcggaagagaggggggaaaaatccccgcctcgcttagaattcaggcaaaggtttcagtattgatagagaagcatgactggctgggggaaaaaaaaagtcatatttttttaaagtttacagctaccactcctggtttggggttgctatagcaacgaagggccttggaggggggcacagtgtctgcggatctcactctacggagagctgattgataggtcgcctgaatactgtttagacacttctgtgctaggaaccagataacattagtttattaaaatacacgttaaaacaccagtcatctctcttgccccagcattttattttaatcattgttgttaaggaattgttaacaggctactgataggaatggaaggcaaatcccgttagggagctaaacgccatcttgctggggctcgcatgcacaggccgggcggcaggcccatgcagggtgcataattacgataatttggcatgactgattgtctccctctccccccagcccaacccaccctggctttccagggagttagaggcatggctaatcctcgtaaagacttctgttcctggctgtggaggggctccggctgggactgtgcctagctaaggtctccaaatttctgtcttctctgtcactgtgtgacagcctgcatgagtggcagtttgtgccccaagaagagtgtcatcagggccaatgtatatggcctgtccaatgtatcactgcttgggagatgtggtcaagacaagctgggcatgaaccctggtcctgctacttgctagatttgtgactgaggaaacctcttaagcctctgtttacccacctggaaatgggggtgctgatattacttccatttttttggagcataaataagacattccctttagccttctacctggaagagctcattcctcacaaacctgataagacagatacttcaactccattttgcagatgaggaaattgagggttagggaagctcgagagcttgaggagctgcctaactcctacagtttggggaagattcaaggatgcatgtaaactgcttagcacactacttagtacagggttggtactccatcaaagttcttaggtacatactattgacgttagtatcattatcagtggtagaaggtgaaacggctactctcatcatccaaagctcctgctggtaacacatgtctaagagcatgaataatcttcaagcacttggtgggctcttgtcacttttcatgattgcattaatcctcacaccaaccccatgagatgaggagcatcgttaatgcagttctacaggttaagaccttgaggttctcagagacaaaaatcactagcttggggccccccagctggtagcaggcatcactgggatttgaacccatgtcttcatcattccaaaccctgtttgtacccttatgttctactgtcagtgtacctatataaagccacagactgtgcattcacgtaggtctcctattgtcttttattcaacccacatgtgatgtgtgaattttctctgtgttaatactgagcaagacattctccaggcttggcttgaataccttaagagagttcactgtaaaatggaggccaacttcatagttagaaagttctccccagccgggtgtggtggctcacgcctgtaatcccagcactttgggaggctgagggcagcagataacctgaggtcagaagtttgagaccagtctggccaacatggtgaaacctccatctctactaaaaatacaaaaattagctgggcaagctgggcatggtggcacatgcctgtaatcccagctactcaggaggctgaggcaggagaattgcttgaacctgtgaggcagacattgtagtgagccaagattatgccactgcactccagcctgggtgataaagtgactccatctccaaaaaaaaaaaaaaaaaaaaaaagatctttcttatgctaagcccgaagcccagcctgcccacactagttcaaatctccagagccacagagatacagtatcttttcaagtgctagcccattgcatatgggagaatcatcatcaggcccaccttttataagttcccttttggttcatctcttcattcttccattcacctatccgctgttatctagtcatcctacaaacatttattgagcttctactgtatgccagatactcatcaggaacagggctgtagtgctgaagggcacaggcacagttctgcctccaggttgttcacattttagttggggagaaaggtactcaaaactattttttaattcatttgattataactcttaagaattataaaggggaacaataggattctaaagaagaaatgtaaggttctatgggagcccatcaccaggacaagtaggaattgatttggcaaggaagaatgttggaaggcaactcagtcaagatataccagagggaaaagcattccagggaaagtgagcagcatgtgcaaaggtcctgtggtaagaaagaactcagcatgtttgaggaactaaagagcagtgtgtctgtggagagtgagtgtgagagagagggagattccactggagaatgatgaggtcagaaaactccattccttgcctctcactttgcttctcgaacacagacaggagagtaggaactggatcctggatggagcctgaaggttggaaaagaagtcaggctctctcatatttcacctggacctcaatctctgaatatgtttgtgacagaatatgtttgtgccattgtcaccttattaagctgacaactatgtttcccagaaactccctccctgtagggtttcagcagaaaactgtcccacagaggaacttgtggggaattttaaaagcagaagtgaagctcagccatagccctcagaacgccattgtgtctgactggtagaatggtggcaggtgttcccaggaggctctggctggtcctcaccctgctgcatgccgtgtttctagcttgccttcctaaaccctggccctgcgaaccaaggaagctccaggccaccaccagatgcttggctgcagactcgcagaagcgcagccacacgctctggatggttctctgcagaaatatccgcgagctcccctttctggtctcacttcggctggatgtgcttagactctcctatttcccacttgggccagtgcttcaggcaggtgggctagtgactttttccgaagctccagctccccctccagacccccacttcccagctccttgcacaggtagatgcggtctaattcctgtaacaaatccttgctctcataataatcattatggctttgtttccctgactgaagcttgaccaacatgctggataacatcatcaatgggagaggaaaagagaggaggggagggaagaagacgggagagggaaaaggaagggaaaggaaggaagggaaggagatggaagatgagggagggaggggggaacttcctattgaactttgaactatttttttttaaattttagattcagggggtacatgtgcttgtttgtaacatgggtattacatgcatactggtgagggcagggccttctagcgcacccatcactcaaatattaggcacggtacccaataggtaatttttcaacgctcactccctcctaccctctccctttttaaagttcctccctagagtctgttttctccatctttatgttcatgtatgcccttcgtttagtagccaattgtgagtgacaacatgtgatattcgattttctgcttctgtgttagtttacttaggataatgtcccacagctccatccatcttgctgcaaaggacgtgatttcattattttttatggctgtatagtattccatgatgtatgtatgtatgtatgtatgtatgtacaatatatatatcacttttttatttgagacagggtctcactctatcaccagggtggagtgcagtggcgcagtcttggctcactgaaaactccacctctcgggttcaagccattctcctgcctcagcctcccgagtagctgggactacaggcacgtgccaccatgcccagctaatttttgtatttttagtagagatggggtttcaccatgttggccaggccggtctcaatcccttgacctagtgatccgcccgccttggcctcccaaagtgctgggattacaggtgtgagccaccacacccggcctatatatcacttttttaatacaatcaactattggtggacacttacgttggctccatgacatcgctattgtaaatagcgctgcaataaacatataagtgtaggtgtctctttatataatgctttattttcctttgggtaaacagtagtgaggtttctgggttaaatggtatgaactttcaactggtctactgaggttatcttcaattttcaattgtcttgagggacacaagacagtttgtcttgggagcaagtcacccttgctggcggatggccttcatttgataattgaggtaaacaagtttccacaatgagaggtgagatgagaacagaattccagttcttcttgttcttacttctgcattttcattccacacaagtccaccctgttgggacagcccattccatggctctaccccatcattcaaggatcaagacctagtatggtacctgggttcaactaccggctctgctactttctcagtgtgaaccttggtcaagttacctcacctcttatttcctcctatgaaaacagaaatcataatcatggtacctggaaatgttcaatgatactgtagatagaaagttctcagcatggctgggtgtggtggctcatgcctgtaatcccagcactttgggaggccaaggtgggtggatcacttgaggccagcagttcaagaccagcctggccaacatggtgaaaccccatctctactaaaaatacaaaaataagctgggcatggtagcacatgcctataatcttagctactcagaaggctgaggcaggagaattgcttgaacccaggaggcagaggttgcagtgagccaagttcacaccattgcacaccagcctgggtgcaacacagcaagactctgtctcaaaaaaaaaaaaaaaaaaagaaaagaaaagaaaaggaaagacaattctcagcacagtgcttggcatttagtaagtgttagtgttattcttattgttgttacagtaagtccaaatttctctacctggctttttatctctgagtcaagtaaaatatgcaaatgttagtcatggattttttttttttttttgagatggagtttcactcttgttgcccaagttggagtacaatggcatgatctcggcttactgcaacttctgcctcccaggttcaagcaattcttctgcctcggcttcctgaatagctgggattacaggtgcccaacaccatggctggctaatttttgtatttttaatagaaacggggtttcactatgttagccaggctggtctcgaactcctgacctcaggtgatctgcccaccttggcctccaaaagtgttgggattacagtcgtgagccaccgcacccagcctaatcatggttttgtccaacgtttccccagagcagcatgtcctggctgctttctatgagtgcttcactgctcttttacttgcatctttttcctggatccttaaactgccagtgaggtaggcacggccagtgctcttgtttggctatcccaaaagccattctcaacctgttttcctctacttacctcctactatggagagaataaagtcaggctagatagctgcagatagatagattctccctgcagctcagagtcaacatgagacccagctttgttccatgaaataaaaggggagaaattcctaaagaagagtgtttgggaaggcgttagttagtttcctgataaaaaggacaagttgtgttagcacttcccatactcctcctttctgccttggaatgtgattgcaatggctggttctgtggcagccatctttcacacataaggatgaggagttaacagctgggcatgggagaccgcatgtacaaaaagagcctgagttcttgataacaccactgaattactcaacaaaccctgagatgcatatgtgtccttatgttttacaccatttttcaacatgtcttttacttgcatatgaaagcattcttaactgataccagaggtcttactatgcctatttacatatggtggtggagaggctcaaaaggttgggcaaattgcaaaagttctcacagctttaaaatagcaggtttgaattcagtgccagattctgccagtttcaaaacccaatctctttaccaagaccaatgttctgtactcaatgaacgtaagtttctctactttaccttctcttctccatatatttaaattccattctgattttagttcaagttctggacccgccatgaatctttccttgattaatccagtacacagggagctcctgcttcgttgatccctgtttctccatgaaggcaccaccctaccgtctgacacttaatggttttccagcatttcaaatgcattgtacttttgacaccactccaccgaacccccattatatcacatgtttcttaaggtcagagaagcaaactcctatagggtaatagatcagaggatttggagactggttcaactcccggttcttcctcttgcctgttgtgtgtctttggggaaaagtcagttcatctactatggtctcagtctgatctatgaaatgaaggtcatagctgctgcgacgtattcaggtgaaacccatttgtaaagcaattagcagagtacctgacttggaatagatattcaaaaatgatagcaaccactgttattacatgttatatttcttgtatacagtcttagtgtgtggcagagtgacaacaaatagtatgagttcgataggcaactgttaacagaatggtccattgactatttcattaagaccttactgagatgtcattctattccagacaatgtgctaagtatttgactttaatgatttttttaaagtcaaataaaatacccttgtctttgacgcatgaacagataactgtaatacaatgtgacaaattcaataataaagaaattcatagggttttatggggacacaggggaagggtacttctcaaatccaggaggacttccaggaggaggtcccaagttgaatcctaaagaagagaagaatctggatgatgagtccttttccagtccccagaactctgttatccttgccaggagtaagttacagaaacagcagacgaagaagtggcatttgtgcatctgtgagtagggacacagattcatgtatatgataattgcttttgcatcttaggacttctatctagaggctggattagttagaaacaagcttccttttcaactttgctttcatttcagcttttcctcctgcgtggtaaacataaaacccattctgtaagggctctcctatttccttttaggcacgaagcatattcttagaagcagcctgccgggaaacaaaggttaattctgcagggaatgaattgctaaagctgcgttcttatttgaagttttgatttatggaagcaaccgtgggtttttctttgctttgcaaaattctttaatgtctccatttcaggcagatccgtcggcgtcactccacgcgtgggccaaagtcactggcaagattttatttgactctgctattcttaaaaggcaggagacaggctttgtcaggactcacaggacctctagcaagggatgctcagttggaaggcttccgtcccactagcccagccatgtacagggggctgtaaagtcagtaggcaagaacaaggctaacaggagtacttaaataagagttcctgcggctggtgcatttatgaaatatcagaaggtcacagaagtcagcctcaattggttactgtgctattgaagtgctgttgtgttccagctgtgagcctctgactggctctagctggtctgtaagggaatcaaggttggtctcaaaggccttccaaggttttttattgttgttgttcctatataagatattgctgtataacatggattgtttggtaggtctaagagggtattatggtctcctcttattcaattacggtatcatattgattcattcactatgtgccaggggtgatcccaaatagcactagacaagcagggctgcaacatatatttctgaagttcttgtacgacatgccgaagaaaagcgaggggttgaaatccactcgtcaaagctatgaacccatgcaaccggcatctaccaagaagatgtgactttttctaacccacctttttggagagggtgtttttttctaattcacgcagaggtgcacaggaatctagtttaggctagcctctaccctgtctacaagataatcgtagttcttgcactcatgaagcttttattctagaagagaatgaggaacaagccacaggtaaagaggcaaacttaaaatattgaagatgacttcatattaagtgcaaaaaaataaattattagtgtggtgttagcacagtgatggcggaaggatgttaccttaaatagtcaatgaagacatccttaattattagcctatgagctcagactgaaggtacaaaagaccaagctagtgaaaagctaaaggtccaagagtattcaaagagtccaacagtctaactacaggaagttgaatgtagatttcccaggacatttatttgagagaaggggagcttcccagtaatagcaatcgcactgcatttccctctagcttctgacattgtttttgtgctcagaatcaatcgattccttgctattcttggtgggcagaaagtctttgcaaaacttgacctttcccaagtgttatcaatacagctaatagtgatgctgtcagaaatgtccaacaatcatcacacatcaaggggctttctgagttcagcgctcttggttcagagtttctgctgtccttggaatgtgtcaatgtttgttgaagattatttctttactgaagttcaattatggtgtcatattgattcattttatgtcttatatttttacatgtttatgtgtctgttttcaccaataggctgtgggttcccaaggggcaggggttctgtgtcatttcattttgtgcccccccacaataaaacagtgtagagttcaaacagttagtcaaggcagtcaatactttcatgtcctatgatggtcacatagtcacatggggtgttatttcaatactttgcttaactgattggcagactgatagatgactaggaatttcaaagtcgccatcctagggtgatgaccttcacctacatattataaacaacttgagaatgagtccacgcatttttcccctacttgggtagtttgtatatgtgctgccctaacctgtcttcttaaagggccccccaaaaattgactctgataaatcagtgaataatgtaatatttactgaagattccatggggtaaatatgagtttacattgtgcaccaaagttaacaacctaaaatctctttgatatttcttttaaggaaagccttctcttccgtactgtctagagactgtgtttttctctccctaatgtcctaaacagccccccaacttcactgacatctctttttcctgactacatggagcctttttttgttcccaaatcatttgtcagagcttatcttctaaacaaccattgcactctgttcaagtggagtttgcataacagcttcttagagaatagtccccatgttgattggcctatagaccccaaagtgttttgagcataatagatgttcaattaacagctaactgaatcaactatagcccagtgccattatgatatactgtgctataaaacaaaaagggagagagattctaatctttctcagattcctcaagatctgcttcatacttctgttgtaaggggaggtattgctgagccctgtcatgctgagccctgtcatcagccaaaaggcaaacagagtttctttagtcctagtcttgccagaatgggggtcactccggaatgttaaccggttaataattctaaaggtgcacaactgtatgtacgtgggataaaccacttcctactcagccactttatggtttaggaacttgtctagtgccaaaaagctaatgccattgggaccccagttagtgactctccctcaattccttcttccttacatggtttttaaaatattgaccttgctggagtttgaggccagcctggccaacatggtgaaaccccatctctactaaaactacaaaaatcagctgggcgtggtggtgcgagcctgtaatcccagctactctggaggccgaggtaggagtatcacttgaacctgggaagaggaagtcgcagtgagttgagattgtgccactgcactccagcctgggcgaaagagtaaaactccgtctcaaaaataaaataaaataaaataaataataaaaattaaaaaaataaaaaaaccttgccaaaaggctacagtacctgtgttatgacacttctcccaggcctcagatgattgatccagagtggtgcgtgactctagttaagagtcaatcacattctctttctctctgtcggatatctggaattgaggcatggagacagaattaggtgctgaactggaaggttctgtagacctctgtatcagcagatgatggagcagagttggactaaagagaaaggacatgacatgggcagagacatagtaagagttcctgatgattttacagttcccatgatgtctcccacatttgcatttgtttcaatgaaattccccctgaatcttttttttttttttttttttttttgagacagagtctcactgtgtcacccaggctgaagtgcaatggcacgatctcggttcacctcaacctctgcctcctgggttcaagtgattctcctgcctcagcctcccgagtagctgggattacaggcatgcatcaccatgaccggctaattttgtatttttagtagagacagggtttctcacgttggtcaggctggtctcgaactcctgatctcaggtgatccacctgcctcggcctctcaaagtgctgggattataggtgtgagccactgcacctggccccctctgaatctttataactgcttcacttttcatttgtcctcctttgcatgtgtctctggcacataaaccaaactatcctgaactaaccacaccttgtcaccaaaacagaggcaaccaaccctcccatgcaccttgcaccaggggcacctcttaacacattgaattggaattcatgatttacagatttctctcttaccaggctgtgagcaaattgaagtcaaggtctatgattttgtccctatatccctactatctaactcagcaccagggacatagtaaatgcctaataaatgtttgttgaatcaaattaaaaacaatgtcatctgcagaataaaattaggttcctatcgatttgttctaagccctatttaccgcaggagaccaggattctacaattagcttacagccatgcatttacatcttgcaccaatcacaagccactttggggactcttttctaaaaataatcccattcctttaattatatcactgcctctggcagaaccagattgccctctgtgggggcttttgaatgcaaatgtatgtgtaagcctgcgtgtgcaatactgaacgtcggtactagagccattttcattattcaataagcccttgacccacctcttcagactaatggaattacactattagttgtgctgtctactcctttcttttgttttcttctgattacaagggtaatgcaattagagataattctacaatgatgtcacaggtagccttggtgtccacctccccgccactgagaatcaaaatccatttacctacaatatcgtaatcttgctctgccccaattggtcttcagcatccttttagccaacgctggtaggaagttctacaggaaatatagcgaagcctgccagggttgcctcttctgccattataaaatgttacttgcggcaaaagcaagggattatttttcttatatgctgtgtagttcaccaaaatggtgctgatggtatttaaaaaacaaaaacaaaaaaacatgaaggcagggcatggtatcttacgcctgtaatcccagcactttgggaggccatggtgggaggactgcttgagaccagcctgcatgatatagcaacactctgtctctagaaaagaaaaacaaattgatagggttaataaataacaaaaatccatattctaaaacaataaagaaacagttatgcaaaagtatgatttaaaaagctttgactagaactgaattaactctgtaaataattagaagcaatactgaaaggtgatcatttatgtccacttaccgtcaattttgcctgggtatttcaaaatgagctaataaaaaaatagtaaagcatgttttacactgtagttcttctttgtcgttctctccaaaaccttaatctttatacattgtaagatcaaatatctaaaacactacatgtatattatttttacaaaaatacatagaagtttgattctatcttaaattggataattcagaattagataccgtacctactatgccatttgatctacatgtaccttttcctagaatggtagttctcaaacccctattcgtgttagaatatccagtgaagctttttaagtgtttgccctactcaattcaattaaatgtgaatctctaggtatgagattctaatggcatttcttaaagtttctcagatgattccaatacacaacccagacagagagccactgtcctcagaaatgtttgggagtgcatggctgggtgcagtgactcaggccaggtgtggctgctcacgcctgtaatcccagcactttaagaggccgaggcaggtggatcacttgaggtcaggagtttgagaccagcctggccaacatggtgaaacatcatctctactaaaaatacaacaacaacaaaaaaaattagcggggcatggtggcaggcacctgtaatcccagctactcaggaggctgaggcaggagaatcgcttgaacccaggaggcggagggtgcaatgagcccagatcgtgccatggcactccagcctgggtgacagagtgagactccatctcaaaaataaataaataaataattaaataaaaataaaaataaacatttgggagtgcaaatcacctgtctgtcttaaatagcaaacttctcactttccaaaacatacctcaaaccactggattcagacaagcagaacataggcataataatgaggaccaggtttggggaaagggctgtgtagtatagatgggtaagcatctctgtggaagtaatttgggtcgtatctatagaagttagatacctcagccagcacatcttctattgcaaatttgcagagcacacttccaatcagccaatgttaatttggttaatttggttgggggtcagaatacagagtacagccttcctatggggaagcctcattagtcatcattaggagtatccattctgcctggttgtcttagagtctttgcctttcttattacaaagtattagatagaacatgagaggatgccaacagccctgcagattgaacaagcaagatgtcttagaggtgtggatagcactttacactctcccaatataaaacatttaaattaaatattaaatcattattattcagttggtcaacagttatgatatggtcactataaagaaaaataagtacagtccaaccagagtaaaggaaatgtatcctcagaactctgaattttcaggtttgggaggtattgggaggtactttagaagtcaagcaatccaacttctacattttatgtatggaaattctgaggccaaaagaggactgcaactggggtttctaattctcgactgccaatctttcttcctaatcctggaagtctgttttcttgatcttatcagcagttgactttttaaaggcactgcctcctcatcccatagaatggattactattatagcattgcaggatgaacatggtggcaggggagtacgtggtttccatggttaaactggggtataaccaggacaggaacactggcctcctccctgcaagtctagaatgaccacacgactgtgggccccagacaaaccgaccatattctaatctgaacctccagctcagaaagtgttaagtgtatcatcttggacaagataattcacctccatgaatatcagttttctcataagtaaaacggatgtaattttttaaaaaaaatctgtcttgcaggatagttgtatagatacagtgagatctttagaggtcagcagactttttctgtaaaggaccaggtagtaaatattttaggctctgcaggctacatgaggtctctgctgcgtattttttctctctctctctgtcttacacacacacactttaaacatgtttaaaaataaaataaacattctgagcttatggaccatacagaagcaggcataggtcacagttttccacagctgatcaagaccacacgctgcaagcatgcagcaaccaggcatgtctttgtgttgttattcagcacccagcacccaccacagtatcagatgcttgggtatttactcaacaaaactctgaataaataatatgtaaagaggctgggcgcggtggctcatgcctgtaatcccagtactttgggaggccgagacaggtggatcacctaaggtcagaagttcaagaccagcctggccaacatggtgaaaccctgtctctactaaaaatacaaaaaaaaaaaaaaaatagctgggtgtggtggcgggcgcctgtaattcccagctactcaggaggctgaggcaggagaatctcttgaacccgggaggcagaggttccagtgagccgagatcgtgccactgcactccagcctgggtgacaagagtgaaattctgtctctaaataaataaataaataaataaaatgtaaagagcctgatccaaagtctaagatggaaaaggcactgtgtgtttatttagcattgttactgcccttgtggcttataagctccagaactatgatttaatatgaaagacaggatgagttcactcattaaagtatttggaggaaaaggagatgagtagaagtgttgcagaggaggaggcactggcctgagcttggaaggatgggtaagtttttggataaatggataaatgaagaaggtaccagtgtattaaaaggaaaataaggaggttatgcatctgccactgtaccacggtgtatatatgctatcaggacaaggttatggcttcacaaagaccacctccttatgtgatttcttggaatgtggaactcagtggctgctgaagtgagatacaggtaaattcccatagggagaactgacctctgatcattttgagtttcaatgagagtagaatatctctgagacaaatatagacctattaaccagtgaacattaaaagatactgaaggcctcccatgactcaccttgaaatagagaggaaatgcgcccagctatcttggtacaatgccaatatctcaacacttacagaagctgattctgcacacaaattgtgcttgagcctggaaacttcaggggacccagacacctgagcagtatagtcatattctgagttactgactttgcatatgaatgtaaattgaagacctttaattgagaacctggacctagatggctgggcaaagtggctcacacctgtaattccactactttggaaggccgtggaaggtggatcacttgagcttaggagttcgacactatcctggacaacatggtgaaactccgtctctacacaaaatgcaaaaactacccaggtgtggtggtacgtacctgtagttccatctacttggggggctgaggtgggaggattgtttgagcctgggaagtggaggttgcagtgagctgagattgtgccactgcattccagcctgggtgagagagcaagatcctgtctcaaaaaaataaaaaataagaaagagaaactggggctaggataatagcaattgtggttgagtatcgttacggataaacactttctccttcttccctctcccgctatatattccctccaacacacatgctcagaggagtttttgccaggccagcattaaggcttagggttgtgttaatctaatcactaaaggaaatgtgacttaattaatacctccaagcttgtgaatggcaacataccactgtgtaaacataatcacactattccttccatcttcattaacagatgagaaaatagtctcaaaaggtgaaccagcttgctcaaggtcacaagctaagcaggggagtaggtctttctgtcttttcactaaaccctgtggcttacctaaagaatgaattataaatgcctagcatcaggtcatctctcagaaatgggttttggagggcagaagactttctctgagcaagaatttgaaagacagacaggggaggcagaaagagtgaagataaacatcaaagttgttttccttgggtagagaaacaccagattccatcaatcaagttagcagggttctctggtcttctttgagtactggagcttggattatgatgacacccagctgactgtcaggccactgttgcagtcaaaatttacacaaagatcgggcccagggttgcaacgcaggctacacaaagctgctggtacgaggagtcaagaagaaacagacattggccaagaagacaaatcatgtgccgcttcctcattcggaataactggccatgtctagtaaatgcaacctctagattcatcatgccagatgggttatttcaagtacagatgctagtatttgttctatttcattcaactctttgagattgatcaataaaaagatgtatatggtgcctgtgtgtctggcattaaaagaggaaagaaatgacctcagtgaataagaacagtacttggatttcttagcgtgcctaggaaaccccgagtaaactgggcagattcaagcatgtgatgaatttctgctgtctgatttaatatttaatattttaatatttaatcctaaagttgtgcattccacttctttggttacagaatattaagaagtgaagctattaaaaacactaagtgttttagttcaggaagagagcacaaccttccctaagtgacaggtgatgctgggtgtcttcgtttatttgtttttgaaaacgtgggctttatttcttaaatatttattattaatgcaacaatcaggctacccaggatttatatagaaccttgtcttccaaggaatactctggttgaataacatcatctgtctttatgaacttcaccgtcaggaagaaggcgagactaacttttgatttcttacagatgggaaaacagagaccctgagagatcaaacaagttttcccaagttacagaataaatctattgaattccctcacacttaatgctgctcaaaccagcttgtgttgtctatgacaggaaaatctctgctacagactttcagagaaatgtcccttccacttttcatttgatgaccactcataaaccttgacttacaagaagatatacgtgaaacggagacacaaacattgcactgcaaatggctcaaatattcatttgtggaagaaacacttaagttcctactgtgtgcctagctctatctaagcactagagctgtgttttcacttcttattgctgctgtaacaaattacaacaaaggtcagaagtcctaaaatcaagttgtcagcagggctaccttccttctgcatgtcttgggcagaatccatatccctgccttttccaggttctaatatatatattataatatatattatatatatagtattatatatagtataatatatagtattatatatactatatatagtataatatatagtattatatatactatatatagtattatatatagtattatatatactatatatagtataatatatagtattatatatactatatatagtattatatatactatatatagtataatatatagtattatatatactatatatagtattatatatagtattatatatactatatatagtattatatatagtataatataatactatatataatatatagtacatattatataactattatataatatatattatatattttatatattataacatatcatacataatatataatgtaatacacatataatatataacaatacatcacacgtaatatataatgtaatacattatatatgtattacattatatatatacccccaaaaagtaaatttttaaaaaaatgtgcttccctcaaagcattgatcagaagattaaatgtataatgtaatacatcctatattatatatgatatatataatatatatgatataatatatatcatgtatatgattatatattttatatatatatatatagttgattgattaagttttgagacagggtcttgaaatattgcccaggctggaatacagcattgctgtcaagcctcactgcagcctcgacctcctcagctcaagccatcctcccacctcagcctcccttgtagctgggaccataggcatgcactactacatccacctaatttttctttcttggtagagacagagtatatctaagtttcccaggctggtctcgaactcctgggctcaagcaatcctcccagctgagccttccaaaacactgagatcacaggtcccagcctttccagcttttagaggccatctgcattctttgactcacggaaccttcctccatctttaaagtgcatcgctccgacctttgttttcatcctctcatctcctttttctgactttgactctcctgccttccttttatgaggacccttgtgattctatcaggcccatctggataatccaggataatctcctcatctcaaatccttaaccaaatcacatctacaaagtggcttttgccgtcaggtaacatagtcacaggttgagtggattgggatgtgaatatatctgggaggagagacattattcagcctggcacagactgtcaagaggttttctagcccttgcagcaatcttcatttcgtgggaaagaggtgcacaaacaattgatgacaaacaccatggtaagtgacaagcagtgatgggtaaaatgatgggcctccatcccaggctaatgggggtgaggaagacttccagacagaatgatgtctaaagctagtcttcaaggatgaatgaggaatgctcatgcaagagagcaaggtagcatgttggaagttgggtcgtccaggaaatgaggacacagcaggcaaacagcacaccagaggccgaggagagtccagttgtacagttcatctgcctatagtgtttgcttcgcattggtcagctttgttttagagctaccttgggtggcagacagacaaaaaactaggctgtatagcaaaaaaattaagagtaagagcaggccagtcgcagtggctcatgcctgtaatcccaacactttgggaggccgagtcaggcagatcacgaagtcaggagttcaagaccagcctgaccaaaatggtgaaaccccgtctctactaaaaatacaaaaattagccaggcctggtggcaggtgtctgtaatcccagctactcaggaggctgaggcaggagaatcccttaaacccaggaggcagaggttgcagtgagccgagatcacaccattgctctccagcctgggtgacagagcaagactccatctcaaaaaaaaaaacaaaacaacaataaaaacagtaagagcaggaggctgggcatggtggctcatgcctgtaatcccaccactttaaaaggctaaggcaggtggatcacttgagttcaagagctctagaccagtctgggcaacatagtgagaactcatccctactaaaaaaaacataaataaataaaaaattaaaagttgcccaggcatgattgtgccattgccctcccacctgggtgacagagcgtgaccctgtctcaaaaggaaaaaaaagagtaagagaaggtaatgtgcccttcattcaagccctgatccttcttaaaagtttgtttaacttctctgctcctcagttttctcatctgtcaaatgggagtaataagagtactaatcttaattgttccaaacataaaataattaatataaagtccttagcacaatttctggcacatagtgggtgttcaataaacgttagatttttctcttttagttccctccctttcagcctctttggcaccaggacactgtcacacagtatcttagtctgttcaggctgctataataaaataccacagactgggtaatttataaacaatagaaatgtatcactcacagttctggaggctgagaagtccaatatcaaggtgccagcagatctgttgtctggtgagatctcactttctgcttcaaagatgacaccttctagttgtgtcctcacatgaaagaaggggagaaaaagctccctctggcctctttcacaaggtcactaatcccatttatggaggctctgttctcataacctaatcatcccccaaagactctacctcttaatactattgcactggagatgaggtttcaacatatgaatctagggagatgcaaacattctgacaacagcacacagttcgtgttttcacccatgccgggaaactcctacaggaagagcaggtgactttccctcgagagcctagttcccagggagccatcaacacatgtcccatcacagagatgacaaggacttttataggatgtgatgtgctacgttaaatacggttcagaccaaacaagaccatgccgggcacacccataccgtcaggtcctctcgattttccgtggttggaatttcacttttctctgtcttaaaacagccagatgggcggttattcttggggataaacaaatagctgtgatttctgtttatgggaggagccctaactttctgggtttttccccacaacactgacagtgtcaggcagattaaaagatgtggggcctggcgcggtggctcacccctgtaatcccagcattttgggaggccgaggcgggcggatcacgaggtcaggagatggagaccatcctcgctaacgcggtgaaaccccgtctctactaaaaatacaaaaaattagccgggcgtagtggcaggcgcctgtaattcccgctactcgggaggctgaggcgggagaatggcgtgaacctgggaggcggagcttgcagtgagccgaggttgcaccactgcactccggcctgggcgacagagcaagactgtctccaaaaaacaaaaaaacaaacaaaaaaaaaagatgtggagctcgagccagatcagctgctaggaaccacacccctttagtcaagtgctataatctcagtttactcaccaacaaaatgaaaactttgaatgagaagatttgtaagagcccctcctagatctaaaattatcttcttctatggcaagtttagagcataaatagaccccaactacaagaagtcaacctgaactgatgggaaaaacaaaattctggggtcagacaaatatgtgctgaaatccttgtgagattcacccacagagctacttaacttccctgagtcttggcctctataaaatgaggataaaagttcttgcctcaaatggatactccatttaccctgacatgattattacatatactttgtatgcctgtattaaaatatcccatatatcccataaacatatacacgtactgatatggtttggctgtgaccccacccaaatctcatctcgaatcgtagctcccacaattcccgtatgtcatgggaggaacctggtgagaggtaattgaattatggggtgtggtggggattatcccatactgctcccgtggcagtgaataagtctcacaagatctgacggttttataagggatttcccttttcacttggccctcattctcttttcctgcctccacgtaaagccctttgttcttcctttgtcttccgccacgattgtggggcctcctcagccatgtggagctgagtctattaaacctttttcctttataaattaccctgtttctggtatgtctttatcagcaacgtgaaaacgaactaatacacctaagatatacccacaaaaagtaaattttttaaaaaatgtgcttccctcaaagtgttgatcagaagattaaatgagatgtcataggtaatggaaagtcaggcacaaaatcagcattgaatgattattgaatacaaaagtggaaaggggctatgtctcaccaaagttctgtcttcacattccagcggccagcccctgttctgagaggttttctctttaaaatgttaattttttttcaaaacaataaaaacatcagtcctcttccccacccctctctaccattaattactgctcttaaggggaaataacttttaattttcaggcctttttcatggtagtttccctccatatacctaaataacatggttatgcagctatttctcaattgatcaattttaacttcttgttaatggtattgaaagacttagtgcctcctcctgctcctgcctctccccatgcactcacatcctagtttagtgatatcccgttgtttttgttaaatcagtaatcagtatatatgttactacagctattatcacatcctgctaatttagtgatatcccattgcttttgttaaattaataatcagtatatgtgttactatggctattaatccaagtagaatacaatgattaagtttcttcttcatatagatttagtttttcctgatgttaatgctttttttttctgccctttgacttattttttatgtacccaacatgaattcttcccagaaatctccaacagaacactaaacaaattttaatggaataaaactccccggcgcggtggctcacgcctgtaatcccagcactttgggaggccgaggcgggcggatcacgaggtcaggaaatcgagatcatcctggctaacacgatgaaacccgtctctactatcagtacaaaaaattagccaggtgtggtggcgggcgcctgtagtcccagctactcgggaggctgaggcaggagaatggcgtgaacctgggaggcgaagcttgcagtgacgcgagattgcgccactgcagtccagcttgggtgacagagcaagactccatatctaaataaataaataaataaataaataaataaataaataaatataataaaactcatcagtaagctatcagtccttttataagaagtacctcttcgagacaccttcccccgtgtgaatgtgttccactctagacctgctacctcacctacctccttccacgcttcatcccttcccatcctgctgggtttacattgaacttctctcctccactgaatcctatttctctgatttcctatcttatttctcttgattttcttttttctcttgagatgaagtcttgctatggcccctaggctggagtgcagtggtgcgatcatagctcactgcagcctcgacctcctgggctcaagcaattctcccacctcagccttccgaatagttgagactacaggtgcatacccccatgccctgccttgactttctttctttaatttttggagaggaatagcctcccaaagccttttcaggtacaattttgagtccttgcatgtctgaaaattttcattatatcctcgtacttgattaatcatttgattggatatagaattctaggttataagtttgagagcatggacctattaccttccagcttctagtatttctattaagacattcaatatcaattcttatgcttaatccttttaatgtgacctgttattattcccttgaagcttttaggattttctctgcatccccagaattctgtgacttaagaatgatgcaccttattacaagtttttaaatttattttactggatactcagtgattccctgtagtctagattttcatgtctttcacttccggtagttttgctccatatgtctgaataacatggttatattggttgtttcttaatttatcaattttaacttcttgtaaatggttttggaagatttagtaccacccccctcctgtctccctcacacactccccaacacttttacggtatttattctttgatagtcttctccctgcaattttgtgtctcctctctttgcaatttctgggagtcccacatacaacttctgaattgttcttctactttttttatatctgctctatgtttttaatctttgaatcatgtttttgccttcttgcaaatttcctttttcaactatgcttttaagtgacttacctttctgatttttaatttccaagagttgtttcttattctcttacagttcattttttaagtagcatccttctcttgtggcatggatggaatatcttctttaatctctgtgaggctcttaattatcatttatttgaagttttcttctgctgcctgtattgtctgcttttcacaagttgcattagttatattgtttgtatgttttagtttgttcctcaccccatgttgaaggctttccttaagtacctgattactctttattttgtattaatagttgagtgagataaatctctctctctgtctctctctctctctcacacacacacacacacacacacacctcacactaatcagaggctctatggataggattcaccaattcaagaattttatggaccaagccattctgttaagattatcccaaatgtcagtatccatatttacttttttcttggtcctttctgttactttcagaaaaattcttctaagccagatacagtggctcaagcctgtaatcttaacacttttggaagctgaggcaggagttcaagatcactttgggcaacatagccagaccccatttctacaacaatcttaaaaaatatttgaacccaggagttcaagatcagtttggtcaacacagtaagtccccatttctacaagatgtttaaatgctggcttccagcattccagaagctcagagaaaatgggctgggtagccacaccattcagtgtactgattttcattcactcttcccattgtcgaacctcacatgcctattacccactgtctgatatttgtgaataaagaccctgccctggttcaatttttccaaatcttcacctccacttccctgcctgggttcacagggtgggattgggtgtctgggagtctatctatcaactagctctcttgtcacgagcacctcctttgctcatgctatctgaggtacctgaagcctccaactgctgaaagtttctgaggttctgtgacccaattccccttgattttggtttataatctcccctcagtggggccttagatttcagttttcttcactcggttactttggttaccattcatcaatccacatactactgctcaaaacgcagttgacatctcttgtccaatattgtcttgtctcttattctagattccccctctcatcctagtttctcattctattcatactggtttatctcttctgtgccatttaaatgggagtctctggggaggaatggagataaatgggtgtgttccatctgtaatgtttaactgtaatgtttaatgttctactgagggtttctttcagtgaaagattttgcatgtgggaaacacaaggaaaaatacagagaatgtgcttccctgataaagtctctccctgggctgctcattcacaatggcctcattttctagagtaacagaaattatctagggccactctgtctccctaaagaactggatgacattatcttgaattccaacctcacctctagttcacctgattctcatcattctcaaaatttatacttttcctaggaatcttttttctctgctcagatggactgttttctttatatctgtcccagcatcatctcaaatctgagacacaagactttttttttttttgtcatttcagtattccatctcccaatcccccaaacacaaaggaaacacccttctgaaaataatctgcctgtagaagactgaagactggaaagtaatagtttcttctccagactgaatgctgataccagatggtgagattttaatttttctaatcctgctaccatgtctgtgtatacgtttatttctaaaatgaacacaaaaatccaaatagcatgggccttctatgtactctgatagaagaaatgagaaaatgatggtcttcaatcaaagaagacctgctattataagccaagaatccttataaaaagaaacatttaataggatatcctatatctgcttttgatttccatatcccaagaaaggaagaagatatttagaacaaggtcaagaggtgacaaagaacatctgcctgcgttgcttcatttaatcttctcaataagtttgtgagatattatttctttctattttccagatgaggcaatagaggctatgtgacttccctgaaacacacagctagaaagtgacatcaccagtaattgtaatggtaaccgtttctgccccaccgtgcttgcaatacacagtgatagattacatagatatatagattagctatagatatatagattagatagatacatagatgagattagacacatcgattagctagattacatagatacatagattagatagatagattagatagactgcatagataggatagattacatagactggattatagttgtgtgtatccatatacatatacacatgtatgtgtgtgtgtgtgcgtgtgtgtgtgtgtgtgttttcactctcatgattacaaatagatgatattcttctttctcatttttggaaactaagactcagagaagttaagtaacatgctcaaagtaacagtcacaaagtgcccatctctccccctctcttttcttccacctcctcacactgtctttaactagtgtccagagatagtgcccagtaatccctccccatcctgcgtgcacttggcactcctgacataaagaggagaggtatattttcccaacccttgaatcttggttggctttgtgactaactttgacaaagagaatgtgacacaagtgagattctgagcttccaaactcaagccgtaagataactggccactcctattccctgcgtcatggaattcagacaccatattgtaagaaactcaagctgcatggagaaaccacgtggaagagaatggagatgctctggtcagtagccttaggtaaactcctggctgaaagccagcaccaactaccggcttcatgagggagccatcttggttgttccagccctatcaagccctcagattatttcagtctcagtcaacagcatgtggagcagaggaatcacccaagtgagctcagtcaacctacagaaacacaagatagaatacaagtcattgttttaagctactaagtgttgacgtgttttttgtgaagcaagagacaccaaaacactgcctatctttgaaagcatgattgcaaaacctgatgtctttctattagagcaatttcactgacacagtctcttccactaagaataaaaatggcacgaatcattgagcacctagaaatgacaacatttgaaaacaagacactcaaggataacttagagatggcaaattaaaagctcatatagctttggtaagagtgtagagaaacaggaactgttactcatttactgtttgtggtagtataaaataatgaagtgttcctggagggtattttggcaatgtcttataaatactcagaccccttgacccagatttgtcacttgcaagacatttatccttgggaaccataaagacatatgcaactattttttcctgtaaaagtgtttactataatgtttggtataatactctttataacagtgcagagaaagaaagagaaacacctaaatatgcaacaataagggatttaagtaaataaaaatattttcacataacggagagttactacattgccactgagaataaggcaatgaaagtttttaatggcacaaatgtgcattcaatattcagaagaatatatgagacaatgtaagccgtttccattggtttttgtaagcaacaaccacaaaaattataactaacaccaagataggactatctgccaagcactcttgaaggacataacatcaaataaatagtgattgtctttcagtggtctcattacttctgctttatgccttttaatgttcactaggtattttttcaataaacatatgagaagaatataaaaacaacccactattatgagctgagatataatttttgaaataggttagtaactttgagatttctgggatgatttaaaaaaacagttctgccattctgaaattgtcatatgtacaagcatacattctcatggggcatttttgggacagtagcttcggccaaattccagagcttgaaagagcccctgatctcatgcatatttttagtgcatacttttaggccaattctgagccatctcctgggactttctgtaccaggccagttcccagttttgtttctgccatatgcattaggcaagagattccaaggcattctttgcaggggttggatgaggtacacattcagtttcattgcatcccagaagttttaaactccctggggattcagaacatattgctaccttacactgtataagcctgggaaacaggggtccacctgcattctcaaatgaccctcctgcaattagaaatgagatttctagtaggacttctatttcagtgttaacaccagacaatagcctttggctctctctaacaagatcggcaagccaggctctgcaaattggctaaatttatattgcacactagaccctctgaataagtaagaaggaaattctttcgttggctggaaaagaatctatacagattctatcttaatcatggtctctaaataggccacacaagtccggtgggcaggagccacatcagaggatggggacgggatctcggagtttagagtgtctgtaatgaaacgctacacctgctacctctcaaagtggaattgattggataaaaacttagtacacaagtgtcatcctgtgcttgcttcccagacgttcaaaatctaaagtttaaggtgctattttcctagagcctggaagatgctctgaattcttagtgagataaacagtgacctggcatactggaggtactctatgtgggaaaataagcaaactgggtgggacattaactctggtacactctgtcatctaatattcatttgatgtaacacaaacctactttccatactggccagagtgcaagaggaatttatttacccaccgagggaaaaactgagggcctggtttagctgcaggcatggcttgatcaggggttaaaatgatgttaacaagatttaattcctctcttcctttgtctttaaattgtgacttgacttacctcatattggattatgttggaaccttttttttcctttttgtcttttctttttctttttttttaatacaatttattccatcatggtcaaaagacagacgcagtgttttcagaacttacatcctcctggtttcaaatttcttgtgagtagagggagaatctcttttcctgaaggtgaagcacacaatatattgtgcctccttgtctctgtttgggccacatacccaatccctgaactaatcagtgaggcaaatgcatagatctaagtataaactcgcttagccctggttcacacctcttccctcatagttagagaagttgggagaaggacatcatctccacccaaaatcatggattgaatccagggagaactgattgacccaaagctcattcaaggtgtacgtacaagcaggagcatgtttggacctggtggcaaagagttcaaatttaacacagatattaaagaaaaatgttaaatgtgccctttaaggaaaccacttaaaattcctcctgcacagagcatcataagctgtcttctcttgctgtcttctctttctgcaagcatgatctacaggatgaaggtacatgcaccttccacttcatcttgcagcccctgctcttcatggaaatatctatctatgcctcctacctacattctttgtccctacatctactcttaaacatgccctgatgaagataggaaaattcctctttattatagtaatagctattacttattgctcccttaggatatacctggtatgatgcaaaatcctttacacacacacacaaaaaatcatttaatcttcacagaaactctaggaggccaaatctactgtgtatacagtgagaaaaatgaaagtcaggaggaggatgaagctcaggcaagaacacggagctactaagtggaagaaaagggttccattatacgattcctgcaccagtgttcacaactctacaatgattccattcagttccgttcttcactctgttgaaccgattccacacggaagggcttctccttgctcactgatatggtttagctgtgtccctacccaaatctcatcttgaattgtagcccccataatccccatgtgtcatggaagggacccagtggaaggtaatggaatcatgggggcaggcttttccagtgctgttctcgtgatagtgaataagtctcatgagatatgatggttgtataaagggcagttctgctgcacatgatttcttgcgtgcctccatgtaagacgtgcttttgctcctccttcaccttttgccatgattgtgaggccttcccagccacatagaactgtgagtccattaaaccttttttctttataaattacccaatcttgggtatgtccttataacagcggaagaacagacaaacacattcacttttccttagatctgaggcttccctctctaaccttcattgctatactcctccctcacaactgtaagtatgctttaagctccagagcactggctgggagtccaatgccttctttcacaccattcctcctccctgtgataggaagcttgtcttctagatatgactatgttttctacttgaaaactgccacgtgcttggccccagggaccctacccactgcttgtgttcttcatctctctgcccactgactggggaatcctacgctggcagtattgtacattccttcttatcttccctgccaataagaagctgcctcccacaagataggtgaaccaaaaatttgcagaaaataaatgtaaatgccccatggcactatgcatagaggctcaacatcactgagaataaaagggataccaattaaaatgacaccatgataaccatttactacctattagatcggcaaatattcacaagctgaacaatgtattccgttggtgaagctgtggggaaacacactcatccatcctggtgtgaatgcaaaaatggtaccatccttatgaagagaaaattggcaatgcttaccaaaaaaatctatgtatgtattgatccttcgactcaggatttccacattaagaactctattccaaggagaagttgtcaaaaacatgaacacacaaatgcacaagcctggtcattgtagtactatttgtaatatttgcaaaggatgggagaatacctaaatttccatcaatggaccttatttattttattagacagtgtcttgctctgtagcccaggttggagtgcagtggtgtgatcttgtctcaccgtacctcttaggttcaagtgattcttgtacctcagcctctcgggtagctggaattactgccaccacacctggctaatttttgtagttttttttttttttttcttgaagagatggggtttcaccgtgttggccctgctggtctcaaactcctagcttcaagtgatctgcccacctcagcctcccaaagtgctgggtacaggcataagccaccacattagactagtataataaactatggtacatccacacaatggagtactgtccaaatataaaaaaagaaatgaggaatacaatcaatccttgttattggtggattctacagttgcaaattcacatactagctaaaatttatttgcaactccaaattcaatactgaaggcactttcacagtcaattgtggacaggcatgtgaacagaatggcaaaaatttgagctgcttatgtgcacatttcctggtgaggccacacaaggtgacactctgtcttcttacttaatctctcgtattatacatgtaaatatcctttacacagtctatgaactgccaaattgtttgcattttgtgctttttgatagtgatttaattgtctcaaatggcccccaagtgaagtactgaagtgctgtccaatgtttgtaagcacgagaaggctgtgaaggggctgagtgcagtggctcacgcctgtaatcccagcactttgggaggccgaggcgggtgggtcacctgagtttgggcgttcgagaccagcctgactaacatggagaaaccccatctctactaaaaatacaaaattagccaggcatggtggtgcgtgcctgtaatcccagctactcgggaggctgaggcaggagaattgcttgaatccgggaggcacaggttgcggtgagctgagatcatgccactgtgctccagcctgggaaaaaactgggagactccatctcaaaaaaaaaaaaaaaaaaaaaagttgtgtgtgaagtaccttatggagaaaaaatatgttatataagctttgttcaggcatgagttatagtcccttagttcactcttaatgaattaacattatatattaaatcaggtgtctttagacagaaacacacataaaacaaggttatatgttgattggtgggtgaaaatgttgtcacacaaggctcacaggaacctaactatgtattttccctaggaccaataattcaggatttactaatctagtattcatggatactttacagaacaaaactactatgaataacgagaattacctgtacctctatatatcattaagatgtgatcaccaggatatattaagtaaaaataaggtgcaaaatagtggatatagcatgctactttttccctaaaaaatgaagcagatatgaagagatattcagttttgtgcatatgtgtatataaacaataatagaatgcacaaaaactaaaaaagaagttacctaatacaaatggtatgaaatacgtgaaggggaggtggatataaattacatttctctgaatataatctgttccaaagattttactttttaagcatgtaaatattctacaaaattataaaatcaaattatatgaaacaatctaaaacaattccttcaaacgtaaagccaaacgaagtaaaataactaaactatgtcaagttcgcggcttaacagtgagaaattatgttacactactttaaaatacactaatttgcctgtatctccctgtgggatacagcttaaggttaaaaataactaaagaaattgcaagttattttcagttaacatattgttagttgtgatattgctgctgttactctggaactgttgtacgaatgtggtaggataaagaagtgagtaattacattgatgctacttgggccaaggattttgtcataaggaagcaagacccaagtatagaatcagaaaacttcagtgtaaaccttttgacctaaaatgtgagttgaaggtatcagcatgaatacctgatgcattctctcttttaaaaaaaaaaagaaaaaagttcatttcctaccttagtcaattttaaagacctattaggtgggtgcaaaagtaactgcagtttttgctattactttatttatttatttattttcgagatggagttttgctcttgccacccaggctgtagtacactggcacgatctcggctcactccaaactttgcctcctggattccagcgattctcctgccttgttggccttctgagtaggtgggattacaggcacgtgccaccatgcctggctaatttgtgtatttttagtagagacagggtttcaccatgttggccaggctggtctcgaactcctgacctcagatgatccgcccgcctcagcctcccaaagtgctgagattacaggtgtgagccaccgggcccatccaccgttacttttaacagaaacaatgacatagcccagactgcagtttctaaatactattcgccacttaaagaaactagggatccttggatacaagtagtcaattcctggtctggggcaggaaatacaaaaggtgtgcccagaacatcttattctaccagaaggcaggaggattatcaaagatcactggggtcacatcaaaagaattcaagagaggttcccaagaagatatttctactagcccaaggttgcttaatgttcgtttcaaaaagaatatatgcaataaatgtaaacaactaaatatgttaaaaattaatgagttcaaactaacactttacaaaaaaaagaaacctcaatggtcatctgtggaggtgttaggataccaacttatttttcagaaaactgatgataaagggaaaacataaaaagcttaacgtgcggggtgcagtgttcacgcctgtaatcctagcactttgggaggctgaggcaggcagatcacctgatgacaggagtccaagaccagtctggtcaacatggcgaaaccctgtctctactaaaccctgtctctactaaaaatacaaagaaaaggccagatgcagtggctcacgcctataatcccagcactttgggaggccaaggtgggtggatcatgaggtcaggagattgagaccatcctggctaacacggtgaaaccctgtctctactaaaaatacaaaaaatagccgggcgtggtggcgggtacctgtaatcccagctgctgggaggctgaagcaggagaatggcatgaacctgggaggcggagcttgcagtgagctgagatggtgccactgcactccagcctgggtgacagagtgagactccgtctcaaaaaaaaaaaaaaaaaagtttaacctgattttcctatattaactctactttgaggtaatcaaagagttgatagtgcagagttcttcttttagaaaaatctcagctactaatcaaatgatagagttatactatcacaactttgtacccataaaaaaatggctccaggaaatggtcatcaatagtagctaaaataattaggcgaaaagctaaagaagaactttagaatgggtgaatcaggctgttaccacttatacccatgggtaagtcttaaaaaagagttaaccagatttaacctgttaaccagacaggttcttgctgtgtttcccaggctgatctcaaacttctggcctcaagtgatccctccaccttggcctcccaaagtgctgggattacaggcgtgagtgactgcacccagcccagaactctttaaaatcaaaattgtacagtcagcgttctcagatgtaaacaatagtgtaataaccacattttctggtttctgtatttaacgcttggacatcttagggccttgctgacctcagaaggataggccctttcagggcgagccaatgcttagaaatagtaaatgactcacctgcgagcatgcttttcatatgcaaaccaaccaaccaaccaacccgagctcatatccccagctgtctccttaacgggactctcactctctctgggccactgtccatctgcccatattaccccagggctggtaccatacaactagagacagcccctacaccccagggtttgctgaaattatgccaactagccaatcctaaagcagcttatcctgtctaactcatttcttccagcagaaaccacagtcaagtctcttgcccatgtccttccttctctccctctacatcctacccacccctggggctcccccttaaagtcctgtgtggcatggagtgcctcctgtttctagagaactgtcagtaaaaacttccacgtctgtgtttccttccatacctgattaagacaaatctcacacactcttaaagcaaatagaaatcaactctggcctacttaggtagcaaaagatcatgagaagctcatgcatattaacagcaaagcaggcaatcattactggggctcagaaaaacattaccccaacatgaaggcctcagaagcagcctgtgttttctctgacattctcctgccctcctgtctgtctgtctcattctcccccaaggctagccatagaaaccagaatccctcttccccaaggatgggtcaaagaaactagaatcccttttccccaaagccaaccttaaaacctaaaaatattctatgtaaaaactggccatgctgggtgcactggctcacgcctgtaatcccagcacttgggaggtcaagacgggtggaacacatgaggtcaggagttggagaccagcctggccaacatggtgaaatcccatctgtactaaaaatacaaaaagaaaaaaaaaaaaaaaaccaggcatggtggcgtgcacctgtaatcccaactactcaggaggctgaggcaggagaattgcttgaacccgggagacagagggtgcagtgagccgagattgcaccaaaaaaaaaaactggtcataaacaaattacctcacctaccttgtttgattgtgggtcacaggatcccccaccccgccccacttccagagaggaccctgccccgcatgcagaggaaggaatacatgctcagagagactatgaagaatctagacagacaggccttgctgggtttccccactccatctgtcagcatttgatcagaccctttttgtcccatcctatttctacatggctgtccatacattgttggacataagcatgaaaatagacaatttcccttgactctttgggtcttcattcttagggctcctatatacacacattaagtatatttgtatgccttttctcctatttatcaatctgcttcatagcaatgatttttcagtgaacctagacttagaaaataagcaaaacccagagaggtctagccgtgcaatgcccggccaaggccactttgcaggatattctgtcaagggtgcgatcactgacaaagccactttgggacgctcagagcctgctgggctctcaacaccaccagtgccaccagatgcttgatgctttcatgactaaatcctcaagatgcaaagtcctaggcatgagcttccgattgaccaagcctacattatgtaactaccctccaggtgccaggaggtagcaaaaaaggaatatttgctctctttggcttctgtcaatcaagaaagtacttcctactagatacacaaaggatgcatctcctatatgtaaaaagaatgtttacaccctaagtaacaaaaaaaaaaagtcagaagaccacaagggaagccacagagaaatgcaaagaaggtaagttttaccttgtcacttgcagagcatgtgctaacatcaccaaatatcacagcctaataaatcatgaaattttttaagccaggagagattggtgttaattgattcacgggccatgaaggactagttcggggctgcacatctattcatcatgaggcttccggtgacttttcagagaagccctttaacttctgtggcatctaattcaattaaaggattgagagtttcactgagtagaaactgcagatgaaaacccaatattctttcatttgactcaaaattatattatccatactaagaacatgagagaggtcaaggagcatgagtcatgataaagagcagctcatcgaaatgactctgcaggaacctctgcaggccaacgccattcagaagagccttgactcagaattgtgactttaagagagacagagagagagaaaaaacaacagagtcaaggccaggtgtgtggttcatgcctgtaatctcagcactttaggaggctgaggcaggagaactgcttgaggccaggaatttttttttttttttttgagacagagtctcactctttcacccaggctagagtgcagtggtgcaatcttggctcactgcaacctccgcctcccaggttcaagcaattctcctgcctcagcctcccaagtagctgggattacaggcatgcaccaccacacgtggctaattttttttgtatttagtagagatgaggtttcaccaggctggtcaggctggtcttgaactcctgacctcaggtgatccacccgccttggcctcccaagtgctgggattacaggtgtgagccaccacacccggccaaggccaggaatttgagaccagcctgggcaacagagcaagaccctgcctctacaaaaattttcaaaatagccgagtgttgtggcatgcacctgtactcctagctactcagaaggctgaagcaggaggattacttgagctccagagttccaggctgcagtgagctatgatggcaccactgcactccagccagggctacagagcaagaccctgtctcaaaaaaaaaaaaaaaaagaaaagaaaaaaagaaagaaaagaaaacaattcagttttaaagacaaactaaagctatttttgatgagtaaaataaaattgctcatatttaatagtatctctctttctacaccatgccttcccctaaaagttaccattaaattaatcagtaagagaatgatagtaaatgtcaagtcaatatcggtgtacagatatgggcttgggggtggaaccatccagactagatggcctttcttctcctttgccttttctgaccttgcacttgcctgaacttcctcatctctgcagagcccacagttccaggtctaagctgtgtctgggctgagtggtgcataggatccaggggatgtgaagcctctgattttcccccaatgagctgtgcaaggaagccatctttgctgtgaagtgagagagacccctgagaagaaagggcaggaagacagacccgtggctgtggattcacttcttggactcagccctataaccagtgaccagattcccctacaacgctcaaggaatttgtccttccttcctgttgatcctattatagctttgactgcacacaagcccagagaaacaggggctggggatcagcaggaggaagctgctgctccctcggctctgtccactgtaacgtactcaaggccaggagccacctatcacccaaaacactcagtgtctccccaaatcacgtttctgaaatcggtaaacctttctttatcaaagttatgaatcctgccttgccttattgttagattcaatttttgagtcacttgttatgttctgggaactatatatacattatctcatttaatcatcacaaatactctgtgggtgttgatatttaccctccctcctcccattttgcagatgacataattgagcctcagaaacgaagacaggatttgactccaagctctgtctgtgcatcttgttttaatttattgttttaatcagcactgaactaatcagattctcctctaaatatgcctttttttataacagctttactaaactttaattcacatattaaacaattgtggattttttttgttttgtttgagacagagttttgcccctcttccccagcctggagtgcaacggcacgatcttggctcactgcaacctctgactcctgggttcaagcaattctccagcctcagcctcccactcgtaactgggactacaggcacctgccactatgcccaactaagttttgtatttttagtagagatggagtttcaccatgttggctagactggtctcgaactcctgatctcaggtaatccacccgccttggcctctcaaagtgctgggattacaggcatgagccacagcgcctggctctcactcttttaaagtatgcaattcaatggtttttactatagtcacagaattatgtcatcatccccaatatctaattccagaatgttgtcatcacccctcgaagaaaccctgtgtccattagcagttacttcccattcccctaaccccacttctggcaagcactaatctgttttttgtctctacagagttcatattctgagtatttcacatgattccatttatatgaaatatctgtgtctggctgcttctttttttgtgtctggcttcttttacttagcataatgctttcaaggtccatataagctgtagcatgaatcagtacttaaatcctttttagggctaagtaatattccagtgtatggatacaccacattttgtttatttattcatcaatggataaacactcgagttgcttccacttttttttgctaacatgggtaatgtgccgtgaacattcatgtacaagtttttacatggacatatgttttcaatttttgtgggtatatatctatgagtggaatttctgggttatatggcaactctatatttaacttttaaggaactgccaaagtggtttttacaatatctgcatcattttatgttctcaccagcaacgtatgagggttctaagtttcccacatcctttcccacattatcattttccaacactgtcttgtttattatagccatcctggcaggtatgaagtggtatcttattgtgattttgaattgcatttccccaatgacttaagatattgagcatcttttcatgtgcttactggccatttgtgtatcttctttggagaaatgtctattcaaattattttcccattttcaactgggttatttgtcttttactgttgagttataggagtttttaattccagacacaaatcccttatcaggtatattacttgcaaatatatttttccatcttgtgagctgtcttttaactttcttgatagtttaactttgaaacgtatacatttttaattttaattaagtcaaattcatctggatttttgttgttgttcatacttttgctgtcatatctaaaaaactattgccttatccaaggccctgaagatttattcccatattttcttctaagagttttgtaatttaactcttaggtttaggtctataatttattttgagttagtttttgcacatattgttagggaggaatctaacttctttcttttgcatatggatatccagttgtcccagcaccatttgctgaaaagacttctttttttttctttgagttatcttggtacccttgtagaaaatgtaagggttaatttctagactctcagttttcttccatggatctatatatctatccttatgccaataccacactgccttgattactgtagctttgtagtaaattttaaaaggaggaagcatgaatcttccaagtcttttttcctcaagaattttttggctattctgggtcccttgcactttcctatcaattttaggaggagtttgtcaaattctgctgggattttaggattgctcagaacatgtagatcagttaggaaatattgtcatcttaagtctcccagtcattgaacatgagatatatttctatttatttaggtctcttttatttcaatgatgtttgtagttttcactgtatacgttttgtacttcccttattaaatttaaccctgagttttttttattatttttgatgcttttgtaaatggaattgttttcttcctttccttttggattgttcattgctagtatatggaaacacaatcggtttttgtatattgttcttatatcctgcaaccttgctgaactcactgattagttctaatagattttcatacgtgaattcttcaggattccctgtctacatacatgagacattcctgggtggagaccaaaattcctggatggtctcttcagatccaaacatcccattatttgtaagcatagccctctcttaccctgttcaaatggacttttttgcttttgttgatgttttattcatttttaccacccagtattcatttcctctcttctggaaatagtattttatttttttccaggaatacacgctctccttctcactctgtccatagtcttcagagaatatagctccaggaatgggcatgtgatataagcctagccatcatgtctatctggctactattagttcaggtctgggcacatggtacaattaggaccaatgggttgcaatctcaggactttgaaaagcataccacaagatcatatagttgtcttttctggcagacttattagagccaacacagagaaaaacagagaagagagatggagagagattgggtctgattcttcacttcagcccagaatcacattacactgggaactcagtctagcccttgactagttcagtgtgtgaaccaataaactctctttatgcattaggcagttatctatcacccacattgatgttatttcagaccatgtgcgaggcattgctactcataagagaccagtattttccctttgcaactcctaaaggctttatgcttaagtgaattgtctagtgattaaaggatagcaaatactttaaaaaaattatgttctctgtttccattctatgaaggaagcccaagtcaagaaaactgattttcattaagggtgtacatatttgaattatttagctctacatttggtaatgcacttggcttgaatttcaagtacagtccctctgatggctaatttaacataaaacacagtccaggcttccttttttttccagcagtttttgctaatggtgactttgccatcagagggtctaggaccatgcagactcagctctatagtattttttaaatgaatccccttagatggaaagagccagcttatatttaccgagataaacttttagagttttgcattatatccaacagtgttaagcaagaaaaaaaaaaaaaccttccaataatcagttccacgagagaggctgttgacttttattcgtttctatagctcatgaacccaaccttgaattccagagagagaaagctaccctcagcttgtgatttaacaagttctgcagttcacgaggaactgaagaggtttttagctctggataccatccctctggctccattcttttagctgatagaaaacaggatattactctagggaaggaggttcttttatctcccagctgtagctttctttagagaaaggggattgtggaagtcaaaacatcgtccttccctgaatagacgagattgatttattagttggcatctttataatcctttcctaagtaaaggcaagaaacagtgcttaccagcgtggatttaaagctcctcatatatggaccaaaaatttgccactcccactcactagaatgtgtccatggaaaaggtcctgaaccagtctgagccttagactccttttctgtaaaatgcagttgataataaagcctacctcatgggaccgatttgagaactgcatgtgataatgatgtaaaatgcacttagctcatgatgtctaataagtgttccttaaatatgttatttttgtgactgtttaatcctcaataagaagagtaaatatcagatatccctgcctccctctaagaaggcacattcccagttcattttcaagactcaagtggccaagacaagcaaactttctagatgtgactgaggctgaacaaagctggcattatctactcctggtctttccagatctgtctgtttttatcccaccaggtccactcgaagcctctcttctgaaatttgaccagaaatgacaaagaatcatgagttggttccactgagcatccacccagaatgatgcctcccaagctaatggcatttttcaaccatcacaatggagtgaatgatgtggatattagcacccctacttacagtcattgatgaatctgctcttggcagtcagagcaccgaagtgtgactgcaacaatggtgagggggagagttagaagggaagataaatgagctcattgtgcctatgtattttggaggccaaggctactatcaggtgttccaagaaatgggatacaaaagaaatgagttttgtcacctaaaaagagaaaaggattcaaccaaggcaaattctgaaaagaaagaacagccagtgtcacccaatttctacctcttccaatcatggcatttatctattttatgtctctagccaaggaaaaatgcaatgcctcctttacaggtttgttctgctggagatagtgattattaaagcaatttgttagaggcagattttgcgtacatattaaagcaagataatcgtattggagacgcttgcctgaagcagggattcagctggaatggccattgcacacaagtctgtttttcagaactgggtaatgatgagcacatttagtgactaagatgcatggcctgatttaatgggatttcccccaaaatatatatggtaatggaagtaagcctgcttaaatagtgggtacatttggaatcctgctttaagagaatacaacttaccaattagatcacagcctattgtaggggagaaaaattaaatctgcccctgaagtttatgtattcattcaacaaatatttatctaacacctactctgcacaaggggctggaaattaacatgtgaagaataagaaagacatagtgtctggttttgtaaggtttccgtgctggtgaaggagatcaaacatagcattatacagttagatactcaattacaatcatgacaaacgcttcaaaggataactacagggcactttgcatgtgagtgtcaggggaactcactctaatccagacaatcagaggttttcttgaggaagtagcatttaagctaaacactaacagatgagaaccacttaacaaatggggtggagaatgaaaatgtgttccaggcaaagactatggcatatgccaaggctctaagtcaggagcaacagtgtaacctggtgtggttggagctaggagagaagaggagaagcgaatgaaggtgctggaaaggttgttagaagcctttgcacatgctgcactgttgcctggagcacaacacagtgctgggacatgcatgcagggccatggtcaggacttggctctggcctaagaacaatggggagccactgagggaccctaagcgagtggcctggcagtagtttagcatttttgaaaagtcactctggaccaggggtggtggcttacaactgtaatcctagcactttggaggctgaggtgggcagatcacgaggtcaggagttcgagaccagcctggccaacatgatgaaagcccatctctactaaaaaaaatacaaaattagctgggtgtggtggcacgcaactgtaatcccagctacttgagaggctgagacaggagaattgcttgaacctgggagacggaggttgcagtgagccgagatcataacactgcactctagcctgggagagagagtaagactccatctcaaaaaaaaaaaaagtacttatattaattaattcagttagtcctacaaacaaccgctgcaatagataccatcattatggtcattttacagataagaaaattgagattcgcagagccaggaccaccccagcaaatagcacagttgggattcaaaaccaagcagtttgagtgggtattaaaaaaaaacaagtttccattcaacttatgaagcaacaacaggcagaaatagaagttgaaatttatgttaatcaccttctgtgattctacactctcaatcaattcagatagagaaatccaagttgactgcacagaggcacggctctctgaaaaatttaacactgtgccacgcttacgaagaatgaaacaggctggatgtcggttccacagcatcccaaatgttcccacccttcgcctcatgacaaaggaacagcaacttcaatttatgtgccaacggatcacaccccagcattccaagggactttgctggggaggaagcgcagtggtttaatggtacagcatgctgtgctgggctaaggatagaaagtagacacagcagtgtggcctccagcttgcatttacagaagggagttcagctgggtgtctggtcaagctggcccagcccagactgggaaaggctgaatgtctgaaagtctcttttggagaagtacaatggaatgctaccaacctgcaaactttcaagttccatggaaaccaactgtctcatgcaggatgtttttctcacaatcactgcaaggatgacaatgggttgtgtaaggtggcacttggagaattaaacttttcatgccattgtttggtacaaagattattggatattgacatgtaatgatgctgtgtgctgtcactcatttaacacctgcttccccagtggactccatgagggcaagagttcagtctgtctgactcaatgctacagcacttagcatgatgcctagaataataataataatgaagaggagaaggagaaagatgctgaagaggaagaagaggaaaaagaaaaaggagaaaggaagataacagttgacatatattacgtaattatgataagcccattatagtctaaaagccttccatgaattgtcattgaattctcacaagaatcctacaagatggattttattactgttacagtttacaaatgaggaaactgaggcatagggaactgcagtaacaggctgactctgctactaagtggtagagacaggattcgaacccatacactgacatcagagtctgtgctcctaaccttatacagtggtgcccattgtaaagagaggagataggtcagtacttgtggaataaataaataagtgtttcagaaacgctcacagtagtaggggacgtggtcaggaagtaaatgagtaccttcctagaaggatatattggaatccctagggagtttttttttcaaactacccacctgtttcttagctactcccacccgctactgctggatgaaaagccttacggtggccagtcacctttagtgattggaagtgtgttttctcactcaagcgtatagggaagaaaaagaaaaacaattttggaaattattgttctagaccagtggttcccaaacctgcccacaaactagacttataaaaaccagataatttacaaaaatactaatgcctgtgccccaccttcaatggattaaattagaactgctaggggtggggccttgacactggtatttcttttttttttgagaccgtgtctcgctctgttgccaagctagaatgcagcggcatgatctcagcttactgcaacctccacctcccacattcaagcgattctcctgcctcagcctcccgagtagctgggactacaggcacccgccaccacacccaactaatttttgtatttttagtagagacagggtttcaccaggttggccaggatggtctcgatctcttgacctcatgatccacctgcctcggtctcccaaagtgctgggattacaggtgtgagacaccaggcccggctgaaattggtatttcttaaaagccaccaagggaattgaatatatggtcaagactgagaagcactaatccactctcctcatcaaaaagcaaccaggggatgctccaggcccacctgattccccttccttagatgttagcttagaggtacagatatcacaggtgtttggtatttaaaagtttaattcaattcaactattatttcatgaacacctcctttttgggtttaattttgggggtacatagtaggtgtatatacttatagggtataggggatattttgatacaagcatacaatgtgtaataatcacatcctcaagcatttatcatttgtgttacaaacaatccaattaggttctatatttttatttttaatgaggtggagtctcactgtgtcacccaggctggactacagtggcgcgatctcggcttactgcaacctctgcctcccgggttcgagcgattcttctgcctcagcctcctgaatagctgggactacaggcgcatgccaccacacccagcaattttttttttttttgtattttttgtagagacggggcttcaccatgctggtcaggatggtctcaatctcttgaccttgtgatctgcctaccttagcctcccaaagtgctgggattacaggcatgagccactgcgctcggccaagttctttgtttttaaatgtacaattaaattactattgtagttactctgttgtcctatcaaatattagatcttattctttttttgatacccattaaccatccccacatcccccctgttttgaaaagatgttttagtctgctctcattttgctaataaagacatatccaagactgggtaatttataaaggaaagaggtttaatgaactcacagttccacatggctggggaggcctcacaatcacggtggaaagtggaggaggaacaaaggcacatcttatatagtggcaggcaagagagcatgtgcaggggaactgccctttataaaaccatcagatctcatgagacttattcactatcacgagaacagcactggaaaagcccctccccatgattcagttaccttccactggtccctcctgtgacacatgggaattatgggaactacaattcaagatgggatttgagtggggacacaaccaaaccatatcaagagataaaaaggcacaaagcacaactttgatcttttatggccccaaagcttaataatgggataatacaagcatagagacgagtatataacatagttacaatatgtaagagaatatggcagagatagataggaaggaggaggaccgacaggaataagggccctaatgaaaagtggaagagtctctctgggcagctaagaaaaatgccatggaagtacagagaaaatggatgcagaagaacaaagcaaagatggaatttcttttcttttttaaaattttttgagttaattgtagattcacatgcagttgtaagaaatacagagaaatcccatatatccttcaccactttttcccaatggtaacaattcgcataactatagtctgtatctcatctcttttctttttgataaaaggctctgagaatgagcagatttcaaaaaaaatttaactatcctatcagataatttaattatgagcatgaatcaacaatgtatttcaaatttgtggcaaaggcaagagactttgctgaccttggaagggacattttctggaaaaagagaagaatgagataatcactgttagactgaatacatgtaaaaagaatgcctggttaagaagatcattagacccttgactgacagtcagctaagtagctgggtaggtagtttcccagaagaggtcataatctcattaaagtttgatataaaactgcttaagcattttatcacaaatcttaatttccttcctagtaggaggttatgaattacagcatgaaaaaacttctgtatcaaaccagatttgggacagtttttctttaccataagccagggatctgagtgaaatgttgagtacccaccttgaattttggaaggaataaacacaataccaagaactgaggccgggagcagtggctcacacctgtaatcatagcactttgggaggctgaggcaggcagatcacctgaggtcaggagttcgagaccatcgtgaccaacatggagaaaccctgtctctactaaaaatacaaaattaggcgggcatggtggcacatgtctgtaatcccagctactcaggagactgaggcaggagaatcccttgaacccaataggcggaggttgtggtgagccgagatggcaccactgaactccagcctaggcaacaagagcgaaactccatctcaaaaaaaaaaaaaaaaaaaaaaagagttgaggccctggggaagatgacccaagaggaaacccataggagaccattcagtaacatggaaactttagtttctgtgtgacatacatgacttgatgtttgttatatattttttccaagttagactgtgaatcctctataatgtaagcttccaggacacggatctcatttgtgatactgtttccccccaccttgaacattatcaagcacataataggctcacaatgcaataaatattgactgaatgaatgaatttctaaacacttaaataaccaggaacactgcctttcctacatttcaagcatgtcaaaggtggggatagttaagtcatgactgtatttcatgaattttcatgaattgatattaggggaacacatgaaggagtgtgttgatatacaccaaggctgaaactgtaagaaaattttcagcctcatcttggccaagaacctctacccagaaacaggggacccaggaatcactcaagaaagccttcattgtaattatgaagataaagaacaaatcagtggttgctgggaattgaggaatgggatgtgattacaaagggatagcataagagaatttttgggggaggagaagctactctgtatcttaactgtggtagtggttacacaaatctatatatctattaaaattcacagaactatacacaataagtcaatcatttaaaaaatgttgccactaaaaatcccattgaatggacaccttgtgttgagggaggtgcctgccagccaacgcactgttgcttccttctcttggaccagcaccaccccccacacgccacctttatgtatgatgaggtctccaggaatgatacttatactgtgagactccactcccatctctatccttcagggtgactgataatgagtagacagcaaactagaccaagtaggtgtctctctcagatatttaaaattgggactgtagctataagtaaatctctaagagttgctggaatggtaacaataatacctaaaattgtgagacagccatatcgtatttcatagatatcaaagttgagatagatggtttacagaatgagagagaaggatgtaagcctaccaaaagaagtgacgataagggaaataagagagagactgagaatcagacatgttggctgactgatttaatgggtttccagtttctaattcctcttctcaaggtctatctactttcttccccttggtttcaatgagctaccctacacccttatgatagtccttgtgtatgcttctgtttaatcaagctcagttatcctgtttgtaaaaacatagactctgaattaatctatgggcctttaaacactagttcaagcaccatcaaatagtcagaatttgggcaactcaacctcttgatgcctccgttttctcatctttaaaaggacaatagtaccttttatacaattgtggggattaaatgagtccatataaagttcttagagcaatgcttgacacataatatgaatccagatatgctgctattattatgactaacacagctttatcagagtctgtctatactctcaatatcatttcatagcaggaaatagctataattatcaatattttctgaggtgagagaacaaaaaacaggaaaccatctcattcattataagaaccccaagacttcccccaaacatgaaaaatgcctcttgaaatgattattctaatctaatgcaaaattatgaacatgaggaattttattgtatttctttaaaatctggtaagatttcctgtgaaattataccatggtatcaaaatgaaatttaagacctttcaccaagtttggtcctattctctctgtggcatgaacacagtggggagttgtggatgatctctttcatctgcattgtaacattgtaattttagagtttataaaacaccttcttggattctattccattttgattttttctttttttagatggagtctcactctatcaccaggctggagtgcagtggcacaatctcggctcactgcaacctccacctccctggttaaactgattctcctgcctcagcctcccaagtagctgggactacaagtgcacaccaacacgcccagctaatttttgtatttttagtagagacagggtttcaccatcttggccaggatggtctcgatttcttgacctcgtgatctgcccgccttggcctcccaaagtgctgggattacaggcatgtcattttgatctttatgacaactctctgaggcaggtattatcatcaaaaatttacagatgaggaaataaaagctcagagagacaccaacatccatccagctacttagtttcatagctagaactgaggccttctggctccaagaattgggcttcttcctaacaatcatattgatgcctaccagattaacagctctgcagatgaagaccagcctgatataattattttgcccacttctcagtttctactaccaactgttatatttcagacctatatattaggttctcacataagtgcagtgagtttagcagaccatcctcactgtatagactgtgaaaccaggtcttcagtaattcaagtccaaggtcaccctttgggtatgttgactagtaattatataaacctggaaaatcaaccaaatatctcttgacttcaaatccagtactttcccccactttatggcactatctctctgatatgtgtttattcttagcgctagaacttcaaatttccaaacaggcctgggtgatagagacatgtgtttcttatggtcaaacaaattgctagagctaagacagaaacacacttgcttttccaagtggataggggcagaatgaaaactaagttcaattgcttgatttgtgcaaatatcacacaagaatacggtagacctatgtattaggttggtgcaaacagaattgcggatttcgccctaacttttaatggccaaaaaacgcaatgactttgcgccatcccaatattatatttcaacataggtgtccaagatagagtgttaagttggtggggtgtgcggtggaggaagcacaacgtaaaacagcttagctgttagcttcaaccataagggggaaagtaacaaacttaaataggttatgtaatgagttgaaatatttctctagaaagatgtcatacattgcaaaataggtcagagctggtcttcggcctaaaagagcagagtttctttgttctttgtgtggttgagggtggaaatccttctataacagatccagctaccccgctactgtggtttgccttaagaaaacaattgcaagaaaggtgggaagtgagagagaatagtatgtgtgtgggggagtggggcggaggggagggtgtgcctgtgtatgtgtatctgtatacgtacagctaaattgtgagatctatgtattaaagagttttggaaacctaggacctgcacctagagacaccacctattcaaacaatagtttgcgcaaatgggaaaataaactgggtaactgggtttggcagtagtataatcccaggtcatggctgattttatgcaagagtttatgaattataccagcacagctggagacctgtgtttcaagagcaatcatctgggccgggcacagtggctcatgcctgtaatcccagcactttgggaggccaaggtgggcagatcacaaggtcaggagatcgagaccatcctggctaacacactgaaaccctgtctctactaaaaatacaaaaaattagccaggcatggtggtttgcacctgtagtcccagctactcgggaggctgacgcaggaaaatgttgtgaacccgggagatggagctagcattgagccaagatagagccacggcactccagcctgggcgacagagcaagactccatctcaaaaaacaataaataaataaataaataaataaataaataaataaataaataataaataaaattaaaaaaataaaaaagagcaaccatctgaaaataaaaactaccaaatccaaaaacaacattattcctcagctgaggaaggtttttgtttttatctctctataattatggtaagcagacccgcctccttaaatagtagaatcacccctgtattatgagaagttaccataggagaatagactcaggacaggaaaaaagatattctcacagtataaggtttcagagatatttaatttagttaataaagggaatgtgacctcacttctatttctgcctaggacagtggcttatatcacactaaatcttctgccaataataactataaaatctgggtgaaaaaaaaataaggctgcttgaaaccactgaagggcaaccaaggcagccagaagtggataaggcaagatcatgaagagataaggatgctattgaggtgagccctgtgttattatccagtgtgtttccctttgaggcatttgccaagtcatcgtgcatggcattgaggccaaatagaaatcagcaacctggaacttgcagctgtcttagcaatgaacttcaagactcccaaagcatccagaacatgaaggtctaagttttcagagaaaaaaagagaatttctgaaaagtgagcctgaaattctacatacaattctctcccaagggatttgggagcttcggcgatgtacatacacatcaagaaaaatgctgagaacacaggaagaaagcatgagccaagaagctacaaagctagatttgcagagataaactttggaggtcaaaggataccaaagataatggacgcttgttagggagaagtgggagagggtggtggtgcagggcagattttgagttgaaacgtcaatgggcattgccctaggattaggggttacactttaggagtatgtacaagctggaaatacagccaatacttacaaaaactgaagcctaagcttctgctaaagcaaggtaatctgctcatactctttctgcctgccagaaaataaaatatatcccctgtagaggaagatatattgtccagagcctctactatctttcatacaaaatatccagcattctacaaaaaaaaaaaaaaaaaattatcaggcatcctgggaaacagcagaatgactaaaaaccctaagaaaacacaaacaatagaaactagcctggaaagaatccagatattgagttatcatacatggattttaaaataaccattattattatttccaaaaacagagaaagagatcgtgaattataggattagaacaccgaagagagaaaaaaggaaatagaaattttaaaattgaaaaacatcaatactcaaatgtagaactcagtaatgatttttagagaaggtaagatagagcaaagaagattaatgaaataacagataactaagtagaacctatccagattgaggcatggggagagcgggaggaatgaaaaccagataagggtgtgacccaagggacatgatagcaaagtttaatgaatgtgcaataagaatctcaaaacgagaaaacagaaaagatagaaaagaaatatttaaagagataaggactggaatttttccaaaactgatggaagatcaatccacagatttaagaagctctataaatactgagagaaaatgaacacaaaataaaatatctgggtaagctgttgcaggccaaagacatagaaaaatcagcaaagagcagccagaagagagaaagggttatattattttccaagggataccaataagactaacagcagatttctcaattaaaatgacagaaactaggaggcagtgctataatattcttaaaaggctgatagaaaataactatcaaccgcaagttctatacacgacatgaaaatgaaggtagaataaatataattttacataaataaaaactaaaatatttaattacagcagactggtactagagaaatattaaaggatgttaagtaaaaataaacacagaagcagtgatcctacagggaaaaaaaagcagtacagtaaggaataaaggcaatggaaaggacaaatatgtaagtaaatccaaatgaatattgactaccaaaacatccacaatttgtctggcagtgttcactatatttttagaattgaaatatataacaatgatgacataaaaaataggagatgttaaataaaagttaactcctgtaacattctagctttgtctgggaaataagaaaaaattgttacatcaagtagaccttaataaggcaatgacgcatattgtaatatctactgaaacccctaagaggaaaataagagaatgtatatgaacatgttaaaaactagccaaaatggaataaaaaataatttattaatccaaaagaaaatacaaacgaaagtatgatgacacattttaccataaatatttcggtaactagcaataaatgttaatggattaagtaatccaattaaaagagattttcaacctagataaaaataacaagctatgggttttatccaagatggccaaataggaacagctccagtctacagctcccagcatgagcgacgcagaagatgggtgatttctgtatttccaactgaggtaccgggttcatctcactggggcttgtcagacagtgggcgcaggacagtgggtgccgcccactgagtgtgagccgaagcagggcgagacatcgcctcacccgggaagcacaaggggtcaaggaattccctttcctagccaagcaaagctgtgacagaaggcacctggaaaattgggtcactcccaccctaatactatgcttttccaatggtcttagcaaatggcacaccaggacattatatcccgtgcctggctcggagggtcccacacccacggagcctcactcattgctagcacagcagtctgagatcaaactgcaaggcggcagctgggggaggggtgcccgccattgctgaggcttgagtaggtaaacaaagcggccgggaggctcgaactgggtggagcccaccgcagctcaaggagacctgcctgcctctgtagactccacctctgggggcagggcatagccgaacaaaaggcagcagaaacctctgcagacttaaatgtccctgtctgacagctttgaagagagcagtggttcttccagcacggagttggagatctgagaacggacagcctgcctcctcaagagggtccctgacccccgagtagcctaactgggaggcaccccccagtaggggcagactgacacctcacatggccgggtacccgtctgagacaaaacttccagaggaatgatcagacagcaacattttctgttcagcaatattcgctactctgcagcctccgctgctgatacccaggcaaacaggttctggagtggacctccggcaaactccaacagacctgcagctgaggatcctgactgttagaagtaaaactaacaaacagaaaggtcatccacaccaaaaccccatctgtacatcaccattaacaaagaccaatagtagataaaaccacaaagatggggaaaaaaacagagcagaaaaactgaaaatactaaaaatcagagcgcctctcctcctccaaagcaatgcagctcctcaccagcaacggaacaaagctggtgttttgttttgcatgactttgatgagctgagagaagaaggcttcagatgatcaaacttctcccagctaaggaggaagtttgaacccatggcaaagaagttaaaaaccttgaaaaaagattagacaaatcgctaactagaataaccaatgcagagaagtccttaaaggacctgatggagctgaaaaccatgacatgagaactacgtgacgaatgcacaagcttcagtagccaattcgatcaactggaagaaagggtatcagtgatggaagatcaaatgaatgaaatgaggcgagaagagaagtttagagaaaaaagaataaaaagaaacgaacaaagcctccaagaaatacgggactatgtgaaaagaccaaagctacgtctgattggtatacctgaaagtgaccgggagaatggaaccaagctggaaaacactctgcaggatattctccaggagaacttccccaacctagcaaggcaggccaacattcaaattcaggaaatacagagaatgccacaaagatactcctcgagaagagcaactccaagacacataattgtcagattcaccaaagttgaaatgaggaaaaaatgttaggggcagccagaccgaaatgttgggttaccacaaagggaagcccatcacactaacagctgatctcttggcagaaactgtgcaagccagaagagagtgggggccaatattcaatattcttaaagaaaagaattttcaacccagaatttcatatccagccaaacgaagcttcataagtgaaggagaaataaaatactttacagacaagcaaatgctgagagattttgtcacaccagccctgccccacaagagaaggaagcactaaacatggaaaggaataactggtaccagccactgcaaaaacatgccaaattgtaaagaccatcgaggctacgaagaaactgcatcaactaacgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcacgtgcagagacacacataggctcaaaataaagggatggaggaagatctaccaagcaaatggaaaacaaaaaaggcaggggttgcaatcctagtctctgatacaatggactttaaaccaacaaagatcaaaagagacaaagaaggctattacataatggtaaagggatcaattcaacaagaagagctaactatcctaaatatatatgcacccaatacaggagcacccagattcataaagcaagtcctcagagacctacaaagagacttagcctcccacacaataataacaggagactttaacaccacactgtcaacattagacagatcaatgagacacaaagttgacaaggatatccaggaattgaactcagctctgcaccaagcgaacctaatagacatctacagaactctccaccccaaatcaacagaatatacattcttctcagcaccacaccacacttattccaaaattgaccacacagttggaagtaaagcactcctcagcaaatgtaaaagaacagaaattataacaaactatctctcagaccacagtgcaatcaaactagaactcaggattaagaaactcattcaaaaccactcaactacatggaaactgaacaacctgctcctgaatgactactgggtacataatgaaatgaaggcagaaataaagatgttctttgaaaccaataagaacaaagacaccacataccagaatctctgggacacattcaaagcagtgtgtagagggaaatttatagcactaaatgcccacaagagaaagcaggacagatctaaaattgacaccctaacatcacaattaaaagaactagagaagcaagaacaaacacattcaaaagctagcagaaggcaagaaataactaagatcatagcagaactgaaggagatagagacacaaaaaacccttcaaaaaatcaatgaatccaggagctggttttttgaacagatcaacaaaattgatagactgctagaaagactaatgaagaagaaaagagagaagaatcaaataagcgcagtaaaaaatgataaaggggatatcaccaccaatcccacagaaatacaaactaccatcagagaatactataaacacctctatgcaaataaactagaaaatctagaagaaattgacaaattccttgacacatacaccctcccaagactaaaccaggaagaagttgaatctctgaatagaccaataacaggctctgaaattgaggcaataattaatagcctaccaaccaaaaaaagtccaggaccagacggattcacagccgaattctaccagaggtacaaggaagagctggtaccattccttctgaaactattccaatcaatagaaaaagagggaatcctccctaactcattttatgaggccagcatcatcctgatagcaaagcctggcaaagacacaacaaaaaaagagaattttagaccaatatccctgatgaacatcgatgcaaaaatcctcaataaaatactggcaaactgaatccagcagcacatcaaaaagcttatctaccatgatcaagtgggcttcatccctgggatgcaaggcttgttcaacatacgcaaatcaataaatgtaatccagcatataaacagaaccaaagacaaaaaccacacgattatctcaataaatgcagaaaaggcctttgacaaaattcaacagcccttcatgctaaaaactctcaataaattaggtattgatgggacgtatcccaaaataataagagctatttatgacaaacccacagccaatatcatactgaatgggcaaaaactggaagcatttcctttgaaaactggcacaagacagggacgccctctctcaccactcctattcaacatagtgttggaagttctggccaggggaatcaggcaggagaaagaaataaagggtattcaattaggaaaagaggaagtcaaattgtccctgtttgcagatgacatgattgtgtatctagaaaaccccatcgtctcagcccaaaatctctttaagctgataagcaacttcagcaaagtctcaggatacaaaatcaatgtgcaaaaatcacaagcattcttatacaccaataacagacaaacagagagccaaatcatgagtgaaaccccatccaaaactgcttcaaagagaatgaaatacctaggaatccaacttacaagggatgtgaaggacctgttcaaggagaaccacaaaccactgctcaacaaaataaaagaggacacaaacaaatggaggaacattccgtgctcatggataggaagaatcaatatcgtgaaaatggccatactgcccaaggtaatttataggttcaatgccatccccatcaagctaccaatgactttcttcacagaattggaaaaaactactttaaagttcatatggaaccaaaaaagagcccgcattgccaagtcaatcctaagccaaaagaacaaagctggaggcatcacgctactgacttcaaactatactataaggctacagtaaccaaaacagcgtggtactggtaccaaaacagagatatagaccaatggaacagaacagagccctcagaaataataccacacatctacaactatctgatctttgacaaacttgacaaaaacaagaaatggggaaaggattccctattcaacaaatggtgctgggaaaactggctagccatatgtagaaagctgaaactggatcccttccttacaccttatacaaaaattaattcaagatggattaaagacttaaatgttagacctaaaaccataaaagccctagaagaaaacctaggcaataccattcaggacataggcatgggcaaggacttcatgtctaaaacaccaaaagcaatggcaacaaaagccaaaattgacaaatgggatctaattaaactaaggagcttctgcacagcaaaagaaactaccatcagagcgaacaggcaacctacagaatgggagaaaatttttgcaatctactcatctgacaaagggctaatatccagaatctacaaagaactcaaacaaatttacaagacaaaaatgaacaacccaatcaacaagtggcaaaggatatgaacagacacttctcaaaagaagacatttatgcagctaaaagacaaatgaaaaaatgctcatcatcactggccatcagaggaatgcaaatcaaaccacaatgagataccatctcacaccagttagaatggcaatcagtaaaaagtcaagaaacaacaggtgctggagaggatgtggagaaataggaacacttttacacagttggtgggactgtaaactagttcaaccattgtggaagacagtgtggtgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagtggattaagaaaatatggcacatatacaccatggaatactatgcagccacaaaaaaggatgagttcatatcctttgtagggacatggatgaagctggaaaccatcattctcagcaaactatcgcaaggacaaaaaaccaaacagctcatggtctcactcataggtgggaattgaacaatgagaacacttggacacaggaaggggaacatcacataccggggcctgttgtggggttgggggaggagggaggaatagcattaggagatttacctaatgtaaatgacgagttaatgggtgcaacacaccaacatggaacatgtacacatatgtaacaaacctgcacgttgtgcacatgtagcctagaacttaaagtataataaaaaaataaaataaaataaaataaaataaaataaaataaataactggctatatgtggtttatatgacactgaacatcaatataaaaatatagaaaagttgaaagtaaaaggatggtaagaaatacccaaggacatagcaaagccaatgtcattatactaatatcaagcaaagtagactttactgaaataaatataatagagataaagatctgtataagaatatgtatagaccaggtgtggtgggtcacacctgtaatcccagcactttgggaggctgacgtgggaggattgtttgaggtcaggagttcaagacctgcctgagcaacatagtgagaccccatgtccacaaaaatttaaaaattagccagttgtagtggcatgtgcctgtggccccatgtactcaggaagctgaggtgggaggattgctccagcccaggtcgttgagattgcagtgagctgtgatcatgccactgcactccagcctgggaaagaaagaaaagaaagaaaagaaagaaagaaagaaagaaagagagagagagagagagagagagaaagaaagaaagaaagaaagaaagaaagaaagaaagaaagaaagaaagaaagagaaaagaatatttaatagaagcatttttcacaaatgcttccccaaactggagcttacccaattatccagcagcataataaataaataagcatattgtaatagtcataagatggaatattacatagcaattagaatgagcaaacttctgttagacacacaattacagataaatactgtagataaaatgttgaacaaaagaagacaaaaatgaaagggtgcatgaaatatgactccatttatcaaaaatccaaaataggaaaagctaatgaatggtggcacaagtcaaaataatggtgatctttgaggaagatgatggagaaggaacatggaaatcttctaggaaatattttccgtattgatctgagtggtgtgtccacttctgaatatttgtcaagcagtacaattatgatttgtgtacgtttatgagtatatgttttacttcaataaaatgctttagaaaaaagataaatttaatcccatttgctacaccaaactactgaaagagggtatatgatctgtttatgataattttaatcattaatagtaacagtagatacttaactagtccttctggaaagaaaaataccacatgttctcactcacatgatagagctaaaaaatttgatctcatagagatagaaggtaaaataatagatactggagtgggaagtatgtgaaggtgggagggggaaatgaagagagattggtgaataggtacaaaccgagagttagatagaagaaataagttctaatgtttgatagctactagggtgatcattgttagcaactgtatattgcatatttgaaagtagctggaagaagacttgaaatgttaccaatgcatataaatgaaaaatactcaaagtaacgaatatcccaaataccctggcttgatcactacacattctatatgtgtgaaagatactcacttatacccaataaatatgtaaaatattatttattaatacaatttaaaactagtcctgcatgtaagtattgtaattatgttaacttaatacttataaaaatctgttaagtaggttctattattatccccatttcacagataaaggaatggaagaagagggagtgtcttagtctattttctgctgctatagcagaatatcacaggctagaacatttatgaagaacagaagtgtattttgtttatggttctagaggatgggaagtccaaggacatggcacctgcatctggtaagatacatcttgtggcagaagggtggaaagcagaaagtggaaagcagaagcaagcactcaacacagagaaaaaataacagccagacttacccttttgttaggagcccactcccaaaatcattaacctactctggtgataatgacattaatctgctcatgagggtaaagccctaacggcctaaaggccctcaccttctaaaggccccacctcttaatactgttaaaaatatgattaagtttccaacaaatgaacttttgcaggatacattcacactatagtagggaggttaagtaacttgccctaggagacacacagttaatgggtagcacactctctccttctcccttccccctccccctctttccttttttcctctcctccctgccatttctctgttgcaccttagaatctcttggggagatttgtaaaaatttcaatgtctagactgcagcctaagccaattaaatcagaatctctagagtggaatacaggaaactggttggttggttgtttttttaaagaaaaacaattccttgataaatgtatgtctgattatcattttaaggatgtgagggttaaagttcaacggggttagataacaacaaatgagtagagggaaattaagaagtggggaaatcagaatttaaaccccaatgtactgaggtctagaatttgagtaccattcctccttccaatgatcaggaacttttgattttcttccagatacccaatcctccacattaaaggtacagccccaacatctgggggtggagagaggtataggtctggcatttatccaggatttttagcttccttcatcagaaaacacctgaagataggcagtcacctatggcaagaaacaaataccaaagatggaactatggggataagacataaataagttttaccttagggatcctgttccagtatgatgtccatgcttcaaacttttataaccaggtccttcaatgactaaacttctttcataagtgtccaaagtaggcttacctttctccttcctgtctccagggtaattaagtgactaaattttaccgaggctacaaaactcacattgaaagaaaattgggtaacactcaagtgggaaaaggagaacttttctaacataaaaatattataattgtgcaatattggccataaaacatgctgagaaataattgtttgaaaattatcattatctaaatctcagtatgggagagataaaagagaacaatgttcacacgagctttctcaattaagggtgctacaatcacgacctccaaacatagaagaaacaaatatatgcagttcttttaaacatatacttaaagttacaaaatggattttgagtgtaatttaaaggcagggtgctccctacgacttacttggttatattagtgcgaagcagggtgtggaggtaaaaagttccctttgccagaagatgtgcttattcctattaacttgtgcccatccactggccagtccccgataaggtcttctttcttaatatctaaaatgatatctacatcatcccaatatcaacttcctgagccacccactcctttgaaattcaaatgaaactggcaaagccgtacaccatatgccatggaaaagctcagtgttaatctcccatctctgtggagctcctcaagatgtccagaaagagttgtcacaatcgctggatcgtttcttactcagagtcccaatattcaggagagaccatttagtttgtggataaactcactgtctgcccattttttcactaatctccatcacttcacccagaatcctcatcctttaacccaggctacctgcgtggcagcctttaccatgaagggggtttcagcacagacgtaaacttagcagcaaagtacctcacagttttgaaattcagtcagtctctttacctgccacagaatttcccatgcactacctcacttggctctgttttcactcctcttcctcctcctacccctttgtttgctccacgcaagccataactccaaaattattatgactctctcctgaggatgtttttacaatctccttgttcactgactccttccaaactattccttgtcatctcacaactttccaagcccaactggtctgtatattaagctattgtgctacaacagtagttctcttcctcaacgaagttctgctgccagattttacatgattcatttttaccatgcttcaaccaaatgatataagtaagctcccttctacttctaaattcacctagtagatggtacctagtctctgacaagcactgatatactgggatacatagtggataaacatgaatgacaaagtccctaatttcattaagctcccaagacagaacttaagagatgcttgtttgtttggaaaaaatacagtaaaatcttttgcattaatgagtgaatgaggggcattatttccccatctgtgacctggaactcagaattgcatacataataatggttctgtctcttcttcttaggatacccacctaggccctctcattccttaaagagaggttacaagctacagaagcaatgctcctaaccaacatttactaaatctgctttatcaaaataaccaaaaccctccatttcttcaacaaaacatactaaatgctctctacagaaagctgaaagctcatggctaacaggaaactctaatttttctgctacattaaccagccaactactacttctaattatatcagataagaaggcttctactgtatttttccaaataaaaacagttccttcccaagtggaaatctaatgcaagctgttgaaaacaaagtaattctgttttcttcttatcacatgcagatgaatggatgcctcagaacgactttgccaggactacacaaaattcacttagtcctgttgcagactatgactatgatcttcttttgcagaaaggaaacgtaggtagttgtcagttgtatcagctacctattactaagaaacaaactcccctaatattcaacggtttaaaacaatacacttttattattgcttataagtctatgggtaagcagggaagttctattgatctgggcaaagtttgggtgatctcatcttatgtctacagtcagctggcaaggtcatctggtaatggctggtcaaggatagccttacatgtctcgtggttggttggctgttgcctaaagtaaagggagtcactgaaccctgtgtcatctctacattcaacaggctagctcatggcagctgggcagactccaaaagaaagtaacaggtacaacatctgctgagggggaggtttaaagctgacacactgtcacttccaacatgttctaatagcccctgtaatttataagatcttatggtttgaattttgtcccaccttagattcataagttgaagccctacacccccaatgtcactgtatgtggagataggggctttaaagaggtaattaaggttttaaaaggccataagggtggagccctaagctaatataacctctgtccttataaaaagaagaagagataccagaagtacacacacacgcacacacacacacacacacacagagagagagagagagagagagaccctgtgaggacacatggcctttgttgttttatcagtctttattgatgaaacaattgaattctttataggaaaaaaagaaaccataatactttttcccccaacaaaaattaattcaagttgaattatatacttagacataaaacccagaaccataacatttctaggaataaaagaatatttttaagaccttggatatgcaaaaaattttttgaacaggacacaaaaagagatgaggtgtcatctgtaaatcaaggagagagacctcaggagaaaccaaacctgacaacattttgatcttggacttctagcctccagaactgtgagaaaacaaatttctgttgtttaagccaccacctagtctgtggtatttttttatggcagcccaagccaactcaaacacaaggtaaacccagactcaaggagtagacagatagattccaactatttatgaaaagagctacaaagtcacattatgaaggttgtagatatagggagggatggagaatcaaagctattgttgtaatcaatctaccctactacatcagttgaggcagaattatcaacactttttgtattgtatttcaattttacctataaatttcagtatttagaagaaagtcagtgggttcccttacacagtggacatagaatgcacccaaaggatcaaaacaagtcacttaagctatagcaaagggctgagactagatatgatgaggtgtccctctaatgcatactagtcctatatagtagatatagctgcatccatagaagactcagaggcaagaagcaggactgaagtctctaggctctgaaatcagtgagcaggaatagagagcaaagagaaatcttcagaacccaacacgttggtaggttggtggtagagccaggaaagacttcctccagttctgaaagctagaaacatgttcctgaagcacagagagattggtatactctcaccagcactcagacctgggtcctgctgaaaggaagtcctgatcccacactcatttgaagccagagacaaattgaattaaacaaaagccacagcaaaacccaaactgagctcaactgcagattagattgcatcagtccctgctgcagtagcctagcataagaatagccaaggtgatcatgagtaaaaataattgagctggagaaattttcctacctgatttaaaaatatactacaaagcaatagtaatcaaaacagcatggctagtataaaaacagacacataagccaatggaacagaataaaaaacccagaaataagtccatgcatttatggtcaattgatttttgaaaaagaatccaagaatatacaatggggaaagaatagtctcttcaataaacagttcagagaaaactggatacccacacgcaaaagaatgaaattaggccttgatctcacatcagatacaaaaatcagccagaaatagattaaagacttaaacataaggcctgaaactgaaaaaccagtagaagaaaacataaggggaaaaccccattgcattgctatgggcaatgattttttttaatcggaccccaaagacataggcaacaaaagcagaaatagacaaaagggatttcatcacactgaaaagcttctgcacagcaaaggaaacaatcaacagaatgaagaggcaaccgagagaatagaacaaaatacctgccaatcatacaccttatgagggagttaatatctaaaatacacaggaaactcaattaagtagcaagaaaacatcctgactaaaatgggcaaaggatctgaacagacatatctcaaaaggcaacatacaaacaggtatataaaagatattggatttctacatctttttttaattgacaaaaattgtatatatttatggagtacaacatgatgttttgatatattcattgtttgatctagacatttgatagtcattgtggaacgactgaatcaagctactgaacatatcaattccctacatatttagcatatcttggtggtgagaacatttaaaatctactctcttagcaatttttacatatacaatattattaattatagtcaccataatgtacagtagatctcttgaacttactcctcttgtctaactgaaattttgtatcctttgaccaatatctccccagtactccaaccccccagctttattttttatatacttttcatataccaacaggtatatttttaagatgctcgacagcactagtcaccaggaaaatgcagattaaaaccacaatgcgatagcacttcacacctattacaatgacttatcaacaagatgaaagataacaagtgttgaccaggaatgtagatacaagggaaccctcagatgctgttggtgaaaatgtaacttagtacagctattatggaaaacagtatggagtttcctcaaaaaattagtaatagaacaatcatttgatccagcgatctctctactgggtatgtatctaaaggatatgaaatcagtgtgtcgaaggaatacctgaactatgttcactgcagcaacaatagctggaattaacctacatgttcatcaatggatgagtggataaagaaaatatagtatatacacacaacagagtattattcagccttaaagaagccctcttatttgtgacaacatggatgcacctggaggacattaggttaagtgaagtaagccaggcacaaaaaaaaaaacaaaatattgcatgaatgagttcatacgttaaatctaaaaaagtaatgctggagaatggggggactggggagatgttggtcaaaggatacaaaacttcagttagacaggagaagttcaagagatctattatacattatgttactgtaactaataacatatttatgtgaaaattgctaagagagcagattttaaatggtcttatcaccaaaaaatgctaagtatgtaagtaaagcatatgttaattagcctgatttagtcatttcacaatgactatcaaatgcctagatcaaacaataactatataaaaacatcatgttgtactccataaatatatacaattttgtcaattaaaaaataaaaacatgcaaaaatcccatacctttttatgactaaaaaactcagcaaactagaaatttctcaagctgataaagtgtatctatgaaaaacctacagctacaccaaatacttcatcataattaatatcaaaattataaacaatttttcccccaagatcaaaaacaaggcaatgatgtatgccctcaccacttgtattcagtattatcctggaaatcataactgtagcaatacaattttttataaaaattgttataaaattgttataaaaattgcaaaagaaataaacttctactaatttgcaaattacattgttgtgtaagcagaagtacaatgtccaaagcaatctaccaaacttctacaactagttagtaagtttttaaaagtcacaggacacaaggttgataagcaaaattaattgtataactatatataagcaacaaacaattgaaaattaaaatgtaaaacacagtaactctccccttccttttctttcctgaacaattctgtccaaaagccatcaggtggggctgaacacattaggcaaccctgcagagaagtagggtaaagttgctgtgggcctctacatggtgttgaggactgagtatgtgtagaggacgtccacaagagaagatggcctatcacagggcatcagagttgagcagactgaagggctgcctacatgagagggtgaccaggtgctaggcaccaaagcccgtgcaggttgaacagggcatctgcttgggagggaagcccagcaggaggtgtcagagcctgaatagccaccagggggcaggagtgacagccatgactagagattggtacctatgatggggttgatccaataaacacattgagggaaatgggagctaggtttctgccaataaagagatatacaaacaaggaaaggcagataattagaataaactctgtagggctggaatgaaagatattggtgtaaacccttggctttcaacaagtatagatagatattcacataaggtatatagatatgggcataaatatagaaataggaatatacacagaagttactgagcacacctaaggctcagatcttggtttctaaataccattctaaaataaaagtagacacaaaataaaataaaagggcttgttggataaatggctaattccagggctaaagaaaaaagaagtacaaaatgaatctggaacactttgtgccagaaagtaagaaagctcttttaaaaataataaaacaaataggggtataattaaaaagacatggaaatcttgaaggtgcccctatccacaaaatctgaaacaatttgagcatcaaaataaaaaataatattaatggattaaagctaagtaaaatatgaaggcatgagcctatactgatagtaattaaattcaaagtttgatgaagaacaaaacagtttcaaaatatcactacacgaaatatttattacaaggggatacatagtaaatttacagtggaaagcctaatagacatccccttcatcaattgatcaaagtgaatatcatcagtaaaggaacaaatcaaaattatatgtcacttgataggactccataagaacactatctcgctctgtgatgtttctgccaaagaggaatagcctgaatctaaccaaaaggaaagatcagagcaatccaaattctacaaaacattcttataatttgtctaggtcaccaaagtcaaagaaatactgaggaactgtttcagactagttcaactaaacataacacgattctggaccagatcaatttcttacaaagaccactctggggacaactaactacacttgaatggagtctgaagactaggtattaagaggggatacatgtctatttcctgatttttatgttcgtatggtggctatttaggggaatattcttgttcttagaaaatacacattcaagtattaggagataataaagtatcatgttggaaactttcaaatgctttgaaaaagtttctttattctgtactctaaacttattggaaattttgagactgtttcaaaataagaaacaatataactttcaataacatcaaaatatcaaatacctggaaataaatgtaatgaaacctactcaaacccagaaaacattgctgagaaaagttaaagacctgaataaatgaaatgttttacaatgttcgtacattggaaggttcagtgctattgagatattcattgtttctaaattagcacataacttcagtatgattcctatcaaaattccagcaggctacttaccagacttacataagataactctaaaaatgtttatggcaaatctacatgtctagaataatgaaaacaatcttgaaaaaggtgaacaaaactggagaactaacattatctgatctcaagccttattctaaaattacagtaatcaagacagtttaatagtggatcataggatagaacactagatcaatggagcaggagagagtgtccagaaatagacccacattcatatggtcagtggatttcacataacggtacaaagtcaattctacgtggcaaagaatgccttttaaacaaatgttgatgaaacaattgaatgctttataagacaaaaaatgaaccatgacaattttcccccacaaacacaagatgaactatgtacttagatataaaactcagaaccataacacttttaggaaaaaagaatattttcaagactttgagtgtgcaagaaatttttgaacatgaccccaaaaacatgataaaaaaaaagaaaaagatttaaaaatgttggactttatcaaagttaaaattttctgcttatcaaaagataccataaagaaaatgaatagacaagttatggtttggaaatatacttataccacctatatatgactatgggcttatatccagtgtacacaaaaactacaaatcaacaatctaattgagcaacctaatttttcaaaattaacaaaatacttgaacagatgcttcacaaaagaagatacatcaatagtcaacaagtatttgaaaaggactcaatgttgttagtcatcaaagggaatgcaaattaaaaaccataatcaaatagcacttgacacccagtagaaacactaaaatgaaaaagactgacatcaaatgtgggcaaggacaaggagcaactggaactcacatacattgctggtgtgagagtacaatgttactacactttcaggactatgtggccctttcttcaagtttgacatacatgtcaaacttatgacccgtctcttcttctcctaagtacttacccaaaagaaacgaaaacacgtttactccaaatcatgcacaagaatgttcatagtagccatgttcataactgcagaaaagtggaaaccatgtaaatgcgcataacaggagaatgccggatgcctacataggaatactacacaccaagagaaagaataaatgacaaatacacacaatacgcacatgcatgaatctcaaaaacagtataagcaacagaatcctgaaacaaaatgacatccaacacataagaatgaccctatttatgaaatctatatataaaccaaactaacctaggttgacagaaatcaggtagtgggatatagggaaggaatgaactggaaaggagtcaaagcgtttctaggatgatggagatctatgttcttttgagtggtgttacactggtatatactattaccaatattcattgaactgaacactttagatctgtgcattttattatatgttaattatggcacaaaaaaacaaaaacaaaaaagtctaaaaggtctagtatgggacttattgcagatgaatgccattttatttttttatgtaatttcaacttttatttatttatttgagacagggtcttcctctgtcacccaggctagagttcagtggtgggattatagttcactgcagcctcaagctcccaggctcaggcgttctcctgcctcagccttctgagtagctgggaccacaggcatgcaccaccacagccagattattttttattatttggagagacaaggtcaccctatgttgtccaggctggtctcaaactcctgagctcaagggatccccctgcctcagcctcccaaagtactgggattacaggcctgagccaccatgccctgacaacttttattttatttagattcaaggggtacatgttcaggtttgttacctggatatatattacatgatgctgaggtttggtggacaactggggcagctgtcacctaggtactgagcatagtacccaatagtttttttttttaatactgtctccctctcttttcctccccacctctagtagtccctagtgtctattattgccagctttatgtccatgaatacccaatatttcacccccacttacaagtaagaacatctggtatctggttttctgttcctgtgctactttgctcagggtaatggcctccagctacatccatgttgctgcaaaggacatgatttagttgtttttatggctacatagtattccatggtatatatgtgccgcattttctttatccaatccgctgttgatgggcatcgaggttgattccatatctttgctactgtgaatactgctgcgatgaacgtatgagtgcatgtgtctttttggtagcataacttattttcctttggatacatacccagtaatgggattgtcatgacaaatcatagttctaagttatttgagaaatctccaaactcttctttacagtggctggactaatttgcattcccatcaacagtgtataaccgttcccttttctccacagcctcaccagcatctgttgtctcttgactttttaataatagccagattcatgaaattttcaatgtttagatttttttcactctataagagcacagtgtttgaaaaattagaaatttaacacataatatgtaaatatggacatttgcaactcgaagcaccgaaacagttgctatgcaacaaaacggagcagcgagcgagccatcacagtatgtcatttgtcacactcaggtgatggcatattgtaacccaactgttagaaccatgctgtttataattcggtaactatacagccacaactacatcattgaagttagtagcaccagcttcaaaatcaagcaaacctggattcaaattctgcctcagaaaatttcctactacatagctcctgactcttcttccaataattctgtgaggcatgagtctggaggtgaagaggtgaaaacttcttccagttccagtctaaatggccttactcggaatctcctcattttaaatctatccctaagcaccacaaggtttagcatcagttccagtggcacaggcaacacagaaattataaataaatacattcttcaactaagcccctcacacccgcagccaccttctccagcttgttgagaaatagcaaacaagaactagatacaccacaccgagtggcgtggatattggatagtgtagccaggatctaaagtgcttttcttgaacaagactgtcaaggggcaaacaggcatttacttatttttgggttgtgcgtgattgacgatgccactctgaggcccaggattctcatttaacgcccctcaggcatccaattgtttgacaggcttaaaacacatgaattctatttccaaagacagagacagacatcagggccctcctaccagagcatgtggaagaaagagcaaacagcaaaagaaactcgctagggagggtgaggccatggacagctgccgctgcatttgttttagagtgtaagcaagaaaaatgctcctttgacatttgaaaactttctatatcctcccctgtaactgccaagctatcccagacttcctcaccacagctccaaatgcccatatttttcttcactcctggatataaatgtgactctcttctctttattataaggcaatgaaaggcctccagacatagttactggcactactgggacccccagatggtttgctgggccaggaagaatgccgtgtagcagtggggaggtaacaggttccttcacaagaagccacctgctcataattcattcacacgcttttcctctgggcaaagcaacaacaatttaaaatagtctaacgtgggccttcctggaattacaaaaataggagtgcatccagatttgaggattggttgccccctcttctctggtgccaccccagctggaagactgccaggaacaggttacggagtctctttaacagaaatggagattagcaggtgttaaagacagattagcaactaaatgagtttctccctgtcataatcagtattcaaagaggaagggtttctagttgggcagctgctaggagtcttttctgacaagaagaaatttgcctggatttgccaggctttagcaaactcaagatatcaaagtgtaaaggtaagccataaatgaagtttgtagcaggcaggcacttggctagaatgtgtaactgagataaaatggggtcacagcacgttttgttttcagggcactttctggggatgggaagggagaagttccatgtttgtgctttttttcctgtggactcagatgctgactctaattccaagactccactggttccacggtgctttctttttgcacccttagatttggccatcagtctggagggcagagggaagagcttgaacaggcttggatgaaataatactgtcttagccagtttgggctgctataataaaaataccgtagactgagtggcataaacaatatacatgtattccttgtggttctggaggctgggaagtccaagatcaagatgctggcagatctggggtctggtgagggctctcttcctagttcgcagacagctgccttctcactgtgtcctctcatagctgagaggccaacgtggtgaaatcccatccatactaaaaatacaaaaaattagctgggggtgttggcacatgcctatagttccagctacttgggagggtgacgtgagagcatcacttgaacctgggaggtggaggttgtgtgagccaggatcatgctattgcactccagcctgagtgacagagcaagaccatctcaaagaaaaaaaaaagaaaagaaagaaagataatctcttttgtgtttcttcctataagagcatgaattccattcttgagggatccactatcatatcctaattgtctcccaatggtcctaccccctaataccatcacaatgggttagattccaacatataaactctggggaaactcaaacattcagtctatagcaaacactatgacagcaaagtatgctgtaatagtcaactaggcttttagagagaaagaaagaaaacaactatttattaagcacctactatgcgccacccactttactaagctctttcattattttattttaatccaaaagacccggtccacattagaagatctggcataagtgaaactaaagacagattgagttgcttatttctttccttcccatggttttgtgtttccttcttaatgttgttttgaatttgtttgggctcaaattatattacacccttgtcatctccattagctaaaatgtatttatggctgattatgcatgcataaaataaattaaatatctgaataacattaccagtaattggtgaaattgccttatgttttcacatccttacaacaaaaaaggcatcaacaaatgaccaggaaaacaaaaggataatccattataattttccttattaacatagtgataggacagacacaattatgggcaatttcagtgtctaaaaatcaagtatgatgaaaattatattgaagttaactaagaaaaaattactttagctattgctccaaaccaactgctagtcaggatgaaagaaaatagcccctacttagaaaaatcagccactgacttagaagttgacactgaatcttttaagtttctacaaactataaaccatagctggagtgttcattttgatttgcctgggtgattctccatgatatggtttcccttcagacaccactgctttattggtgaatcatttatgctgatttagagagatattctagtgtttttctttctaaacacataagtaccaccttcagcacagcctggtatttaaaaatatatgtgtgtacccacacacaagcacacacaggatcaaaccagcataatcattttttgggctgctaatttgtgtgttttgatggtgatgtgaatttaaagtatttgataaccataaaaaccatcatggcataggtactgaccaacggagaaggataccagctgtgacattagagcaaagtactaggaccccttttgtgcaagaccaggggatcacagtaactggggtgcaccaggaagctgctatttaccaaccaaaatgaaagtcttttaatcggttaacaatggtgcaaccataccagggtgtcacaactaaatgtcagtactatacacacacacacacagagagacagagagagagagtgagagacagagagagagagagagagagagagagagagagagagagaaaaccccaaggaaggtctggcctctcccttgacctctgttatcccggtggttttagtcagcatcttgccaaatggacaccccataacagtacactcctgtagggctctggcaggtgacatggcagtccaaaccaatggtcatttctacaaggacaccccttctctttcagccctgacacctggaaaaccagtcttattcacagaacatagtagttgggacccaagcacgggtaccaccacttagattttaaaagccaaagatgtgtgaagtttgaaacagacagaaatgctccaaatccacccaagggaatctaaagaagatgatctatctatctgtctgtctgtctgtctgtctatctatctatctatctatctatcgattgatcgagagatgtggcagggcctgtatctcaagagaaagagaatcctttaccccatcaaagtgaaatttataaagaacagatccaaacatgcctttccatttctcaaaattctttgatggccagcatcactgatcttttaatatggtagaaaagggacttcataatggagcctcaccttatttcttgctgccttaaccctacattcaagcaatagtgaaccatttgtagtattggaaaacatcatgttattctatacccagacttccatttcactgggtgggcaatccattgcaacccacatcataagtcctggaattgtttgctagaaatcatcctagttgccttcatccaagtatcctgagtaacacaaggcttggcacatagtagatcccaatagtttttgttgagtagataattcagtataaccaggcagttctgaagaataaaatatggcaggcacactgtcacagatctttgcctgggagagatgaagacatgttcaatgtattctaagatcacaggatcaaaaatgaacagaggttaaaaacaaaaagactgaccacttccaggagtggtgaagacgaggagtcattagaactctcataccctgctggcaggaatgtaaagtggcacaaccacatggaaaacaatttggcagcttcttaaaaagctaaacatatacttaccataccatccagccatcctagtcctaggtattcactcaagagaagagaaagtatatgtccacagagatttggtacacaaatgttcattgaagtcttatttgcaatagctaaaatatggaaacaatttagatgtttccagtaaaacaactggtgaatggataaacaaattgtggtacatccatacagttaaacacttctcagcaataaaaagcaatgaactattgatacatgctacaaaaaggatgaatttcaaagtaatgatgctacgtgaaggtaaccagacaaagaaagagtatgaactgtacgattccatttattcataattctagaaaatgcaaactaaggataaaaagcaagctagggcttcctgagaatggaagaggaaggggtaagaaggagatattataaaaggggcatgcgaaaacttttggaaatgatgagcatattcactattttgattatgatggttttgagggtgtataggtaagtgaagatgcagctaactctatactgtatgtgctatttgttgaatttcaattataccttgataaagatatataaaagtaaataataactgagcaaggcatatgctttacgagaaaacagtcattgtggtttggggaaatcacaatgagacactaagaaggtaatgggaacactttgactttggaagtgtaagttagagattaagggtggcatttcagaaaaggaaaaatataagaaaaatgtctaacagtcaagactgtccaatgataaaataaactggccttggaggtagtgagttcctagtccctggaagtatttaatttgatgaccattaaatagcccttgaaatggattctcgccctggttggccaattattttctatgagccctaagattcttttaacctctgatacttacttgttcaccaagaagacactggcagggaatatttgctggtagcaaactccctgtcaccgatgctcatgaaaacaaccattaggaattttcctcaagaataaaagaagtgaaaataattcaaaggcttgggacttcaaagaagtcgagttgaaaggaaatcagttcttcagatataggaattactagtgagtacaaagagaagagtgagcgatggagctttggggagagggcggccgggtggctgaagtctgggtgtgagaatatcagggaggggagtaggcactggggtttagaaaacccagggggtggctataaaacacagaactggagtcgtgagcagggattgggtggctcgggtcttgggatgcttcctcacagatgctgtcggacttgctgtggaaataacttcccaaataacaaaacatatccctgtgttcaaaaacttccagtagcctcctgttgcacttagaacaccattaaaatgatttaccagggctacagagatactgctaagtgaaaagagcaagatgccaataaatgggtaacaaaaatgcaacggttttaaaaacaaagataatgaaaattcttttaccacgaatgtgtattctatctgagcattttgcacaagggtatcagtctggattattagactgaattaaaacttctcctcaagcctggcccaggtccccaacaagccccactctggcatatggcactgctctgagggggagacagggataattgctggaagcagagggtgtccgaagaggagcagttgtgacccccaccagccacctggatgaagcaattaaacaattgactgagtgaatctaacaaatgccaaagggatgaaaattgatttgggtaaaagacaaatgaggtcaatttcctcatttctgaaaaccaaggtgagagttaaggacagacccttccccagattccacatttcttccttagtccataaaggagaggatatcgctcttgtcttgtgggaagaaagctgccaactctttttacccatgagtcctccccaagaaaagaaaggatgaatgtaattgctcagagaacaacactcaccggaacatggcttactaaagggcagggatagggtattgcagggttagggcccgccacttaccactttctctttgcatacctcccagacacccccctttctccctcttcagtgccctataggcctgtgggcctcacccctcgatggctatctcaaagtcagacctgacctgtaagtcaatagtctttggcagatgtacagaactgaaattcgaatggcgaggatggcaagaaaagctggcaacttctatgtacctgcagaacccaaattggcgtttgtcttcagaatcagaggtatcaatggcgtgagcccaaaggttcgaaagatgttgcagcttctttgccttcgtcgagtcttcaatggaaccttcgtgaagctcaacaaggcttcgattaacatgctgaggattgtagagccatatactgcatgggggtgccccaatctgaagtcagtaaatgaactaatctacaagcgtggttatggcaaaatcaataagaagcaaattgctttgacagataacgctttgattgctcgatctcttggtaaatacggcatcatctgcatggaggatctgattcatgagatctatactgttggaaaacacttcaaagaggcaaataacttcctgtggcccttcaaattgtcttctccacgagttggaatgaagaaaaagaccacccatcttgtagaaggtggagatgctggcaacagggaggacaagatcaacaggcttattagaaaaatgaaccaaggtgtctaccatgattatttttctaagctggttggttaataaacagtacctgctctcaaattgaaaaaaaaaatagtctttaacttggtgaagaaggtgatatggtttggctctgtgtcctcacccaaatctcatcttgtagttcccataattcccacgtgttgtgggagggacccagtgggggatgattgaatcatgggggcaggtctttcccatgctgttctcatgataatgtgataatgagtaggtctcacgagatctgatggtttaaaaaacaggagtttctctgcacaagctctctttttgcctgctgccatccatgtaagatgtgactcactcctccttgccttccaccatgattgtgaggcctacccagccacgtggaactgtaagtccaataaacctttcttttgtaaattgcccagtctcgggtatgtctttattagcagtatgaaaatagactaatacacaaggagtaggaggctaagatctgtttctactcataacacttctgacatcaaatgtgtgggtttttttccataccaacacccaatgatccaactcttcagacaaccaactgggtgtccaaggacccagttctaacaccaactacccagaatttgcatcagaccccacaggttaagggctcagtcccacaagactgctcccatttcagatgctaattgcaagttctaggtctcctgtacttctaatagaccagctataaataaggggttcccccaccagcacccccatgttcaatggtttgctatgatggctactggaacccaggaaaaaccatttatttactattactggtttattatgaaggatacaaatgtacaccagatgaagaggcacacagggtgaggtcagaagggtcctcagcatggagacatctgtccctgtaggagttagggtgtgccaccttcctggcacatggatgtgttcaactcagcagctctctgagcccatccagtttaggggatttcatggaagttccattacataagcatgaaagattaaatcactggccatttgggatcagctcaatctccagcccctctcccctccctgaaagttccaatcctctaatcacatgattgattcctctggtgatcagcccctatcctgaagctagctaggggcccaccaagagtcacggcatttgcataaactcaggtatggttcaaagtcttattaagagtaacaaaagatgctcctctcacccctctgactcagaaaattaaaatggttttagggcctctctgttaagaactaaggaagaagatcaaatatatattttttcttctatcacaatatcacagagggtctactcagcctcaggcctagccatgttcccagtcgaggtttgaaacccttctttgcaacttgaaaccctgctttggaagtgttaggggtggggaggtgctgctttgtgtggaagctcctttgtcagaatcctggaagggaagaaaagggactggtaggatttgtccgccatgaattcttagatagtaagaaaaattaaaaggatgatacaaaggaagtagcaaattagtctatgcattaaaattggccttagacactcttctgtcttctgatagcaacagcaacaccaccacatgccaccatgaggcacatactgttatcccctttccacatatgagtaagagaaaacagagttaaaacaactaaatatcctgacttgatcattccatgactgatcattctaggcatgttacaaagtctcacatgtaccctgcaaacatgtgaaatagtatgtacccatacaagaaaaaaagttcaaacaaaaattaattaaaatttctaaataaatgtctaattaaataagtaacacagtagagaacagtgggaccaggtaagttccagagagtgtttatcgttgttgctgtttttctttgtgtttttgttgttattgttgttgttgttttttgagacggagtctcgctctgtcgcccaggctgcctctgttgcccaggttggagtgcatggcacaatctcggctcacttcaagctccacctcccaggttgacaccattctcctgcctcagcctcccaagtagctgggactacaggcgcctgccaccacgcctggctaattttttgtatttttagtagagaacgcgttagccaggatggtctcgatctcctgacctcatgatccgcctgcctcggcctcccaaagtgctggaattacaggcgtgagccaccgcacccggcctgttgctgttgttttttaagacaaggtcttgatctgtcacccaggctggagtacagtggcaccaacatggctaactgcagccttgacctcccaggctcaagcaatcctcacacctcagcctcccaagtagctgagaccacaggcacgtgccaccatgcttggctaattttttaatttggtagagtcagggtcttaccacgttgcccagcctggtctcagactcctgggctcaagtgatcctcccaccttggcttcccaaagtgctgtaattataggtgtgagccaccatgcccagccccagaaagctcttacttactgcactattccacctctttgaatgcatgaagggatgttctaattattattattattatattattattatagttttgaaagagaaagacactaaactaaggaggcccagtggcttatctaagccaaaaatagtcagggaagtgcagagaaggcagtgtggtgtagtgggtagcacttgggacttggcccctgaggatcagggttcaaatctcagttataccatgagcttcatcccttcatctgggaaactgagcatcctgacaaggttcagacaagatcatacacatacgagcacttcatgcatgcaatattatgtctggaaagcacagactttgtatgtagtggtttctgttgtcacagctgaccaaccttgagttgacccagtggttctccacccagggtggttttgtcccccaggggaccccgggcaatgtcacaattgacatccagtgagtagaggccagggatgctgccaaatatcctacaatgcacaggacagctccctgtaacaaagaatcatccagcccaaaatgtcagtcggacccaggctgagaaacactggtttggaataaatccatggcatttataacaattcgggagtagagtagatgctcaataaatatttgttgaacatatgaataaataaataatcaagttctgcaacgttgcctacaacgtggttatgtgagagcaatgttagagtaagtaaatgggtggtaaataagccagcaagactgagggataggcaacatccttgctactcaaactgtggtccagcagcttcaccatcatctgcacacctgttacaaacggagcatcccaggttccatcccagacctagtgagtcagaatctgcattttaacaatatccccagagaactcataggcacattcaggtttgaaaactaccatcctagagtctgcatttgggggcaggttatatccaatagcagccctagttccaaccgattagtgcagaaactaaggcctctttaagatcagttctgctgaatcgtccctcttggctataacccagctctatccacaggtggtatttccacctggatactctccatttggataaagaagaacatgtcccccaggcactgagcagggccttctctctctttgttcacaaagtagagcagtgagtataatgaaatatggcacatcatcaataccccctatgcagaaactgcacgggatgctacagctgaaagattccttgaagaggaaaagaaaatggtattgcaacttttatttggagcttgattacttcattgtcttttaccctccgggtgaaggggcagccaagaaaaacaaattctgcatgacgctatgagctcggatccttggttctgaatgctgctcagactttgtcctgtggcaccaggaaaggaaaagaggtgctttgcatcagccacaaagccaaacatttcccccagtcaggatgatcatattcttccttcaactactaacaggtcatcagaactcagtatttactgagcattgactaagtaccatggcactattctgagtattttacatatattaatgcatttagtacttacacaccctatgaggtagaaactaccaaattcttcattttatagataaggaagttcatgcatagagaagttaagtaactttcctgaggtgagatagctaaaaagcaagtggtgaagctaagactggaacccagaaagtctggcttcagagccagtgttcttaacccttcaaccctactgtttacattttagattttataagaataactaagatgaaatctctgctctgatggagtattcagcctggtaaagggagacagataaacagatacaacacacatatcaggcatttagagcaaagacgtactgttgtctccgtttagtaccactcgtattatatctctcatattatttgtccttatttatgtgtttgagacggagtcttgctctgtcgcccaggctagagtgcagtggtgtgatcttggctcactgcagcctctgcttcctggggttaagtgattctcctgcctcagcctcccaagtagctgggattactgtcatgcgccaccacgcctggctaatttttgtatttttagtagaggtggggcttcaccttgttggccaggctggtcttgaactcctgatctcaggttatctgcctacctcggcctcccaaagtgctaggattataggcatgagccaccctactcagcctatttgttcttactctaatttgactcaatgatttagaatcaacaagcatgttataacatgtcaggtacatactagatagtcattaaataatagttgagagaatgaataaataaaataattaatggccaggcacaatggctcatgcctatgatcccagcactttgggaggctcaggcaggaggatcacttgaccccaggagttccagaccagcctgagcaacacagcaaaaaccctgtctctacaaaaaaaaaaaaaaaaaaaaaaaaaacacagaaaaattagcccgggatggtggtgcatgcctgtaatcccagctactcaggaggctgaggtgagaagatgacctgaacccaggaagtcaaggctgtggtgatctgtgatcccatcactgcactctagcctgagctagatgagatgagagtaaaactctgtctaaaaaaatatataataataataattaacaaatgaacatggtccttcaacatgttttcaagaaagtaaggcgctatgtatggcaataggctcttaaaggaaatacctgctttttactttctatccagcactaccccccaacctccctccttaatctgtggaattgcctcttttcccagttcctcccatgttcttcccactggagctataatagctttgcattgcaacacctctggccttagctaactggccatgggtgagctcctgccaatgagttatcttctttgggaattttggaagcaggagaaagaagatcagtacaacttttccaagtagtcaaagctgtacaacgaaaaaaaaaaaaagatatctgttggtcgccacattttcttttttttttttaatttttttattatactttaagttctagggtacatgtgcacaacatgcaggtttgttacatatgtatacatgtgccatgttggtgtgctacacccattaactcgtcatttacattaggtatatctcctaatgctatccctccccgctactcccaccccacaacaggccctggtgtgtgatgttccccttcctgtgtccaagtgaccccaggaaggcagctcgtctgtatcccaagagctccataaagctttatgctaatatgcagctaagagccaaagatgagagatggagagaaattacttctgacatcgttcaagtctctgtttccagacacttaacctctgaggtttcattttctctttcataaaacggagagagtgtgggaggattacatcctgcaaggctacaatcctgctgttcaaggaagaggggctctaaccaggcaaccatgtccaagtaaggggaaagttcactcactcccctctattcaaactcagagcctctagcaccagagtaaaaccagttgaagcaaattccttttgagcttgagctccaccaaacagccctctaattctagagcacagatgatatgccctgactggtgacatgaatgggtaagtttctgtaatgggcatctcatgtttctcatgaacaaaacggcatgctaaatttacacaactggcctcctgtgtcttcggatgccatgagccctttctcaggatctgctcaccaagaggggctcagcattcaaattttgctcccatagggctgaaagagcacactcacttggcttattcataccaagcatctagcatctaggaagatggtttccagacccattacaaggctacgatgctcttcactgaagaagcacagtaccatcagtgagttccaaaagcacatcatggctcattgcaaacagcccttcagattctctagatatctgtttttcacatcttgctctgaacatcctcggaggccactgagaaaaaggaggaagtttaaatgagatggctcttctgcaggcttcaaccgcagcagctccatctgacatgctttaaatatttcagttttgcatatgtcatgtgatacattcggacattttctattttctttcttttttgagacagggtctcactctggtcacccaggctggagtgcagtggtacaatcatagctcactgcagcctcagtttcctgggacttaagtgattctcccatctcagcctcctaagtagctggcactacaggtgtgcacctgtatgttgtacaccaccatgcctggcttttatttattttttttgtgtgtgaaacggagtcttgctctgttacccaggctggagtgcagtggcacaacctcggctcactgcaacctccgcctcctgggttcaaatgattctcctgccttagcctcccaagtagctgggactatagatgcgtgccaccatgcccagctaattttttgtatttttagtagagatggggtttcaccgtgttagccaggatggtctcgatctcctggccttgtgatctgcccacctcggcctcccaaagtgctgggatttcaggcgtgagctaccacatctggccgctaatttttattattattttggtagagacagggtcttactatgttgcccaggcttgtcttgaactcctgggctcaagcaatcctcccacctcagcctcccaaagtgctggaattgcaggcgtgggtcaccatacctggccctactttatttttttttagaatagaaaaagcagctatggcccacaaaattaatatcatgatcccctaatgggccccaacctgaagtttgaaaagcattactccggcatgcccacagaacacgttccagctgggatttgcatccagtgaattcattaggtcaaaggttaccaaccagttcccacagagagcaagggtcctttgaacttaagccccacatgaccggctagcataatgttagaaacaaatcctagaaatttcatctccagaagctctaaatggagacatatacattctaagactctagccttgcttggggagaaaaaaataaatagaaggttatgtggcacagtgtctgtattcccacacaattgcaactagcaggagcggaagtagatgtctgattccctctactctctcccaaaatataagttctgaatggtaagcaatcccaagaccacgtggtctcaccccagggcctccaattccatccacctgccaagcctcctgctgaaaatcccctctcaccatggattctgcaagtctggccagctgtccttttgataaatgccctttgctaagacgcaggtcagtgtaattttccaaaaggttaggaggagtgactgctcagagagggctcgcttattatttcaaatgtcacctatcccattctctaacatttactgagttatttacaacttgattcttgctgtacctgccagtatgtctgacctgctccagtctctcctctcgtcactgtctctatagccctgaaacaggagctagagactaatggccttgcctctgaaagccagggtggtttctaacctaagatagggaaaccaccctaataggtaatttttgcaccaagtcatgccttaaacgtcgatgaaattcacctgttttgaggcatgcatggttgttgattgtttccatggggctgcagatgtttagtccattttcaatttgttcagccagattaaaaacccaatactaatgtttaaactagcaaacctcaaaaagacttcattcatttctcctctaaataatatggggcatttgtttgggtcagtaatttcagttaaagaaactttttggggacaactatttatcccatacgcctgttgaagttataataaaaacagtaacaatcatgataacataaatgtctgtcaagtattcagtgtctactatgcaccaagcatgatgcatggtattcagcctttggctatatataaatatataccgctagagagagttttatatatagttatatcagcggtccccaacctttttttggcaccatggaccagttttgtggaagatgatttttccacagactggggtcagcagacagggtgattgtgggatgattcaagcgcattacattcatcatgcactttatttctattattattacactgtaatatataatgaagtaattatgcaactcaccataatgtagaatcagtaggagccctgagcttgctttcctgcaactagacggtcccatctgcagcgagacagtgacggggcattagtttctcatctaggagctcgcaacctagatcccttgcacgtgcagttcacacagggttcctgctcctacgagaatctaatgccgccactaatccgacaggagacagggctcaggtggtgatgccagcaatgggaagcagctgtaaatacagatgaagcctcgctcgctcgccgctcaacttctgctgtgtggcctggctcctgacagggcacaaactggtaccagtctatggcctggaggttggggaccccaggtttatatggtcatacatagttaatattagttatatgtatagttttatatgtattgttatggttttatatatacatatgatcatttaactcacaacatctctgcaagttagatatcagataattatttcccctttacaaataaacgaaggctgagagcttcagtgactttcccagggccactcactcatgatcagagccaggactagatttcaggactgtccgtactttataccctacccactgcctctcaatcattataccaggaaccatcactttggagccagcatctatgcccttatacacatcaaagcactgagattactcaacaagccaactttgaaaattacctttgtcatgagctttcttttggtctagaataagaattctggaacttgagtgaatctagcctccttcttcccacaggaccaggagatcttggtctcatggcctaacgtcgttgaatagcttgacactggaattagattaaccaggatttgaatcctgctttccccatttactggttacaagatgttgggcaagtcacaaaacctctctgagctttagtttcctcatctaaaagaaaggcaaaagctaataatttctgcctcataggattatggtgtggaaaaagtgaggttctacatgtaaagctcctgtggctggagctgtgataaataaatgttagatactgtcataattaactatctgaaggctgctgcttcaggagctgttagagccatcttacatagcttcattcttacagactgaaatctgtaaaaatagatcatgatacctttacattattgggacaaagtttttacccttcatcccaccctatccaccacccacaatgccaccaccccctcctcctcctctgcggagagaagccatcctccaggctttgaaaagtggggaaatgaaaagttgcagagttgacccaggaaagccccaggttgtgtgtcccaggcttgtcctaagaggtgtcaccttcatctgctctaggaccttctgctcctcagcccacattggtaagcatttccaacccctattagacttactctggggtcttaaaaatatacatttcactgattttactgcgcatgttcttccctgcctcttcttcctcacatgccccttcctcacttttgtatctaggataattaggttatattttgacctacgagtgctcagacctagccagcactatctgctgcattatctgcatcaccatcctggttcagaaccaagtgtgggctggaaggaaggacttcaatgctcccatcccaataaatacttattttctgatcgtaacactctttgtgaaacatcagatctatactggtttcctagggctgccataacaaatgaccacaaacttggaaatttaaagcttccaagaaagaatgcttccttgcctcttccagtttctggtgggtccagggattccttgggttgtctgttttctcctctctgcgtcttttccttatctgtctcttataaagacatgtgtcattggattcaggtctttccctgacaattaggatgatctcatttcaagatcctttactttgctgaacagaggttactagagggtggaaagggtggggcggaaggtggggtataggtatattgtaaaggatataaaatctcagctcaggaggaataagttctagtgttccataacactgtaggatgactatggttaacaataatatatattttcaaatatatatccaaatagctggatgagaggatcctgaatgttctcagcataaagaatgttttagattacggatatgctaattaccgtgatctgatcactatacattgtgtatatcaaaacatcactatgtatcccacaaatatgtacaattatgtgtcaattttaaaaaatgaataacaaaaatattcttaacttgtttacatctacaaagactcctttttcaaataaattaacactcacaagttctaagtgggaatatcttttggggccaccattcatcctattccaagatcctaatgagtcccatgagacctgtggcatgcctttctttcagcatccagctcacctcactccttcaccaaaacaatgccaagaatgagagaaaagcttccattccattccacaagccagatcttcccattccattcccaaactccacattttgcagaaacccaaccctggtagagggggtttggggagtgatatggggaaatagaataaacttccaggaataaaaaggtcccctggtctcctccctaagtcatcggcttcctatggaaaaaggatcactgcatgggacacgctgcccatcccattattcactctctccagcgaggccgaggctgaggaataggcagaatttggcactttccaaaaaacatttaatatttaccttctaggaacaaaatttacattttcagataaatctaggaagtgctgagttaaataaattcaggcaggtttctctattgcaggactggagctctcaatacaatatactatgaatagaggtagaaacaatttgcattatttcctaaatttacaagatcagagaacctgtttatttgtgaggcatctgatggccttagtgttcttccaaatacacaatgggagactctggtgtagatgattctatgcaataagtagctgtcaagccatcagggacatgtaaattaaaactacaaaaatacacctctttacactcactaggatgactataaccaaaaaggcagtaacaaccacaattgtattggtgaggctgtaaagcaacatgggccctcatacttagctggtgggaatgtaaaatggccagttgctttggaaaaaacttggcagtatcttaaaaaggtcaaatttacctatgactcagcagttcccactcctaaaaatacgacatatgtgcacacataaatggttatatcagcttactcataatagccccaaactggaaaaaacccaaatgttcattcaccggtgagtggataaataaaatgtggtatatccatacaatggtattattattagctagtaagaaaaaggagtgaaatactgacacatgtgtgaacctcgaacacattatgctaagtgaaagaagccaaacacaaaagaccgaatagtatataatcccatttctataaaatgctccaaaaagactcatacagagagacgacaactaggtagtggttggcagggactgaggatggattagggattcactgtaaatgggcatgaaggattttactgaagtgatgaacgtattctaaagctgaattgtggtgatggctgcataactcagcaaattaactaaaaattaaattgcacacttaaaatgggtgaatcttgtggtaggtaaactacacctcaataaagttgtttataaaatgtgctatcacggatggatgaaataaaatcgtattaacctacaaaagatacctatcaggctattttctcagccctacgcttgtccaaatgaaggtgctgagcaatcagctttggaagtaaagtttcaagaaccaggtttgtcatcatagttgggaaagttgagcaagctgcataaagtacctaaccatgaaacacctacctgtgttttgaaggaggcattgaggtattttctattgaaggatatcccccatatggaggaatttgcaaactgaaaacacttgtgatgaatccctaatttcactctgtaccctggacaaaacaagacccagcccatagaatttatttaaatggtggaattgattagaattccaggaccaatgcgagagaagttctaagggagagagattgggctctttgatctgcctggttccactctgacttcattctaattagcaaagcttttgaggcagactgataagcattccgggcaccgcacatgtctggccactggctaattaattaatttttgactttgaacagtgacacttaatttgaaaactttctaccatccatggatgaacgtggaaaagtagggcaaaaagatgtaaaaatatgctaaaggtgccatttcaaatccagctgatttccaagagggcaaaatgggtcagtgagttaaataaagagatggactgtggggaagggacaggggagggtgtgctatgccagctctgcttctgctgtgctgtgtgtgtgggcttagccatcgatcctctctgttctctcagtgttttctcagtcattttatttgaaaattaggcgtctcctcggcaccctcatttattgagaaatgactgtgtgcattgcccatagagagaaaaggggcagaaaacaaaaaccatttacagagaggagaataggagggtggacaaagcttataactgcgcagagagtttaagtgaacactgttcagatcagaggtctgcaaaccacatcccaaaggccaaaccagcctcctacctgttttcataaatataatcttgttgaaacacagccatgcccaatttgtatatacgttgtctagggttttcatgctactatggcagagctgagttggtatgacagaaactgtacggcccacaaagcagagaatatgcactctgtggccctttgcagaaaatgtctgtcagcccctgatctagatggagtcagaattatgccttcttggtgtaagtaactaaagggacacccagaaatctttttttttttttaatcttgaaagcgcttctttttctaacaaggagggagctaacgtttttcttagcacctctgtgtggctggtgcaagggccctttctcaaagattagcctcatcccaaatctttgaagtaaagatgaacatgcttatgtcagaaaaggcaactgagaaagctaataacttacctgcaagttacagaactaatgtttaaaccagacttacttatctgcaatatgatgcctccctgctatgtcaacattaagaggaagattttggcaagagcctctgtctgacattccctttgtaagggtcaaagggctttgggaatagactttagagtaatatatttgagcatatttacgcaatcatctgtgtgcccactctatactccaagcttggagagaaacccttctattaatccccctttcaagcaggtctaagtatcccagaccataatatttaacaaacctttatcaaacagttggggacttcaaaatttttcacagagagaaactcatcgctgtcactggagttactgcctctccaatggaaactctaaaaatttaggtccttaatctccctagacccagatgtaaaaagaagttccttcctctctcagcccaaggtcttatttcccgtatcaggatggatggccataggaacagaccctttcttcagaagacacccccactccaaccacacaatggtcttcatcctccaaggtacagacaaggcattcaaaacatctacagagtacttctaaaagcatggttcattcactaccctaagggctatgccaagactagtctaactcaagttcaaagtcctttttccagcctaaaatggagacatcaggtctgattatatttccctctcagcaagactctgttcccctgatcaactataaacaaacttttggaaaaagaaacccagacttctcgcaagcaagtaagcttcaggtatcattcaaccgaaatccaatttgagagagtagcaagtttcctctaactccacaaaggcacagtcctgctaaacataatctcatttttcatcattaaatagaactctgagtatttcaggctgtagcttctgcatttaatattgacaaagattactaagagctcatatggcacccatgtgcaaattagaaaacagcacctcctctcggcaggtgcttctgttaaaattaaagtggtcccttctctgggtgaagatgccccacccacactgggatgcaaggctgggcaaagagagcaagggctgggcttcaatgtcaccattgtgcagtgagcaacctgcgcagccatccatgactgtacttggttttctcgaggaacactagtcattttctttacaactgggccttatatccaaaggcccattctgatgactttcataaacaaagttgcctgtaaaatgtaaaattgatatccacccctaaagaaaaacaaatgttgagatttttctacaaaataatttgaacaacctgagttgaattcacaagtcagccaaccgccagctgtgtgattagacaaattccctgttcatccataaaacggaggcatcaatccccgtactactgagatctcaggaatcccagcactttgggaggccgaggcaggcagatcacgaggtcaagagatcaagatcatcctggccaacatggtgaaaccccatctttactaaaaatacaaaaattagctggacgtggtggtgcgctcctgtagtcccagctactcaggaggttgaggcaggagaattgcttgaacccaggaggcggcagttgtagtcagctgagatcacgccactgcactcctgcctggtgacagagcaagactccatctcaaaaaaaaaaaaaaaaaaaaggaatacttaaaatctctaaatagacaatgcaaaatgacttggtaaacataaaacggtctgtggatattaagcagtaaccacataaaaagacagaaacagcaaatggtatcattggtgcttccatggaaagacatttctcttattcttgatgtttttggccacagtattcttccagcaaaaatctgagaagggccattacttgtccctgattttccaaaaaggtcatccaagcaataaagggtttccaatgtggaagataattagctcccagagccttcccattccacctgatcaattagactaagtactaaacactcccaagcctgaagtgcataaaattgaattgtatgtatgctttcctgttatagaatggtaatgtgctgctttcagaatctctcacacgagctgggagtaatcggaaatttttttttcaagctacctccctgcctggtgataaggcaccggctagctggatgtgtttgactaggatttttaatttcttgggggggaaaaaaaccaacaactgcaatatgggtttttgtttggctcatcagtgttgctttaaagacttctgtggaatgcccaaattgcaactgggctgtcttaacagtgccttccaccgctggaatctgcaatccagaatcagtgactgtgccggggatcagcaccaaacgcaaggccggcccatttttctttgtcaaacgctccccgtgacaggaggagatgttagacagcagtgcaggatttttcttagcaacccacccaagcatagatgtacccctctctcctaggagacaagttattaaaaagatgtatttttgaaagcaaccttctctgcatgcaacatcagtgtcaacaaataaagggggagggaaggaaaggcaaagggggagggaaggaaaggcaaagggagagctgtccagagagaggaaggaaaatgcctctgtgggcacagtttaagaaatgatcaatgcatgtgtcaaaggctgtgataagacacactgagcttatcaaaaacggaagctccaatgacagagttcacatgtgacaggaagataagagaagccgggtttttcctctccctcttttctctccccaaagaccctgttttaatttcccactctgcatgttacattttcaggcccaacagagaccacctaacctcgttcaattccttttctaatctcactgtaaatgtttccaggagactctgatttgcagacgctgacctcagtgatatttggggaaataatgtgcaagtccctgttggagatccaaaacgcagctgaaggtttcagaaaacactgaacatctcaaaaaggagtgttaagaacactgagctggaaattaaacatgcacatacatcttggctcgatcataaacacactctgtgttcttgcataagtcacatcacctaccagaaatggagtctcctcttctgtaaagcagggagagatggactgtgctgtcctatcgagaatatatatatatatattttttttttttgagatggagtctcactctgttgcccaggctggagtgcagtggcacaatctcggctcactgcaagctctgcctcccagattcacgccatcctcctgcctcagcctcccaagtagctgggactacaggcacccgccacctgtattttttgtattttttagtagagacggggtttcactcagagatgtgtgccttgcccacggacatctggccttggaacttaagttgatgtaggcctggcttcccattgctggcatttgcatctctctgcataagggccctctcagctatgggagctccctccattcacacagaaggcagaacagaagtgccagtaaattgatggtgcccagcaatcacattactgagtatatacccaaaggattataaatcattctgctacaaagacacctggacatgtatgtttattgcagcactatttataatagcaaagacttggaacaaacccaaatgaccatcaacgatagactgaacaaagaaaatgtggcacatatacactatggactattatgcagccataaaaaagaatgagttcatgtcctttacagggacatggatgaagctggaaaccatcattctcagcaaactaacgcaggaacagaaaaccaaacactgcatgttctcaatcataagttggaattgaacaatgagaatacatggacacagggaggggaacatcacataccagagcctgttgagtggtggcgggcaaggggagggagagcattaggacaaatacctaatgcatgcggggcttaaaaaacctaagatgacagattgataggtgcagcaaatcaccatggcaaattgttacataggtttgttacctatgtaacaaacctgcacagcctgcacatgtatcccagaacttcaagttaaaaaaaaaaaatgtgttgcccagaagcagcacccaaccaatgaagtcccacaaagacaaacaggatgcttccagaggtcttcagcgaggctaaactccagttgcccagagcagtacttggtgacatcctttactggctgccttcccttccctgtctcacattctaacccttctccccgcaaagtatgtcctgggattaccacccagacatactctctgtcttgtatctgtcctgagatctgctttggaggaaacccacattaaggcagtgagctaagagttaacttcaggcattaactttacgaaagagcatagctgtatcaatgttcaaagaataatggaaatgttttccttaaattccctttcctcaaaacatgcagctctaattctttttcccatccaactccacattccattcataacacgaataattctgcatatttgtggagaagttttaactattcaaagtacttacacatttaaatgtccctttgaaatttacaaaaaaaaaaaaaatctgcaaaatgggagaagcaatagcattaacctcttggtaaatgagataaaccttaaaacacaaacccagagaagtgagttaaactacacaaggtcacacaccatattgatctccgttctctttctggcctcagtggcaccactctttggggtggcatcacctgttggggatcattcagtctcaggagtagggatgggttagagtcatttacaaagcccactgcaccccaccagaatagggacctactataagaaccctttgtgaggactgtcattttctatttccactcttgcacaagtgattactctagaaggggagaaaacagctgttccgataccacccttgatgagaaagaaactgattgagctagaagtttgctgagctagagccagtcaataacgttcaattctttatctcctattcatggagtcccaacactttcaggggcaagatgcaagtgaatggagcttctttgatacagtaattcagagaataggacagtgtattcacaggtttaaatgtcaatgatgaagactaatacaactgaagaaaaatgagccttgtttaaaacaaagagagaagttctcaaactttagcataaatcagtatgttacctggagggcttgttgaaaccccgattactggcttccacttcagagattttgattccagtagatctgggtagggcgtgaaaatctgcatttttttaagtttctaggtgaggccaaagatgcagtcctggacactacactctggggcgtcactgctttaagatattactttccaaatctgatgtgcatacaaataacctggacctatagttattatgcagattctcattcaagaggtccaggctgtctttcttttttctttttttttttttttttgagatggagtctcgctctgtcacccaggctaaagtgcaggggcccgatctcggctcactgcaagctccgcctcctgggttcacgccattctcctgcctcagcctcccaagtagctgggactacaggtgcctgccaccacgcctggctaattttttgtattttttagtacagacagggtttcaccgtgttagccaggatggtctcgatctcctgacctcgtgatccacccgcctcggcctcccaaagtgctgggattacaggtgcgagccactgcgcccggcctccaggctgtctttctaacaagcctccagtgatgctgacgttgccagtctatggaccacagaaagcaatgagactccaagccaagtgtctctcaaagggatgttcaactacccaccatagagtcacagcaagcttattaaaaatgcagaccccagaaggaagactggttttagaccattcaagctattataacaacttaccatagactgggtgtctcaaacataaatgcactgttcacagttctggaggctgggaaatctaagatccaggtggtggcagattcagtgtctgtctggaagtcccctggcttacagacagctgtcttttggctatatcctcacctggtggagggagcaaggcagctctctgaggtctcttttgtaaagccactaatctcattcataaaggctctaccctcatgacctaatcacctcccaaatgcccccacctcctaataccatcacattggggattaagtttgagcatttaaattttgggaggaacataaacattcagtctacagaaagacctactgaaacgctctagtcacggacccaggaatctgcttttaacaagcatattgagtgaccctagaattttaattcatggccctatatggtattccccagccttgaataattataagaatgacctgatgcatatgttaaaatacagattcctggccaggtgtggtggctcatgcctgtaatcccaatactttgggaggccgagtggggtggatcacttgaggtcaggagctccagatcagcctggctaacatggtgaaaccctgtctctactaaaaatacaaaaattaaccagtccttgtggcacctgcctgtagtcccagctactcgggaggctgaggcactagaattgcttgaacccggtaggcagaggttgcagtgagcagagatcgcgccacttcactccagcctgggcgacagagtgggactccatctaaaaaaataaaatacagattactaaacctcaggttagacttactaagttggagtagttcaaaaacaagcctgggactctggactgtgttaatcttccagatgagaaaaactaggaaacagtctgagtgttagtactcacctgcttttcacagtctgggtaccacaatcttccctttaagctttcataggatcctcccaacttagatgtcaacatataacaacacgtaaaggagttctttaactccaaaattctgacaaaaagtttagttgagaatgacaggacccatgctataaacacacttgccatacagacttctggacgatacagtataaagactgcacagtgggttagcacatcagtgcccagttttgtctctctgcaagcagggccatctcaggggcttgccttaagccctggctctcttaagtttgcaccaaagatgggattatttgagtgccttggactcactaagttgcagaaaccctctaaaaagggagaaagagagagccagtaaccctacttagctttggggtgacacagtcttcatgctggagactagctgggatttttagctgagccagagtgagttgggtcatcatcagttggacatccctgtggacatcaagtcagtttccctaaccctgcaaatagagaaagagagtgggaggaaagaaaggaggaaggggaagggaggtgggagacagaaagaggaaattgtgccctcattacaagatgacatttggaataatgtagaaattgaaaacaaacgtcgaacaacttgcaaattgcattttcctgggacttttctcttggcatttttgtttgtttgctttaattgaaagctgtgtgtttcaatgggctcacgtggcatgccatgatcagttattccaaacgacttgggctgcatgatgctctgtttcttgtcagttgcagagcacattttctgtttcaggaactacagtacaatcactttctaactatcatatagcaccgaaatggcttcggcactcaggtgcaatggcacttcctgagtgattgggagggtcgtgcctgggtcaaagatgcagaggggccatgaaaggcagatggcttcctgggtcactacctggggaaaaaaaaagtcagaaaactgaactgaaaaaaccagcttcggggaacagaacacagtactgaggggtcctctgaccctatagtcagaaaagcaggacaaaagcctaagaatgtggctggagcattggaggaattgaggcaagaaacaggtatgaagccacttatgttatttctagacaggttccaaccaccccatcatcttttatgttcttgaaactggaagcttgtaccaatgcatcccccaaatgggaaaagttatataagattactgaacccaaatattaattatttttaccttaccacaggtaaaaacaatttaaagaacacacacacacacacacacacacaagatttacttactgtgataagagttgatacagaaattgctatatgattgacactggaccaataatctgatttactccttgcaaccaccatacaatgtaggtattatttctgttattgtttccattttacaaagccaaaaaaactgacactgaaatagtttatccaaagtaacaacagaagtcataagaggcaaagcagagaccaaaacctgggctgcatgaagccagaggtgggctttaggtatgtatgcatttatttatttatttttgatagagacttgctttgtaactcagggtggagttcagtggcacgatcatagctcactgcagcctcgaactcctaggctcaaaccatcctcctacctcagcctcccaagtagctgggaccacaggcacaagccaccatgcctggctcaatttttactttttatagagattagccccttgcattgttgcccaggctggtcttgaagtcttgatctcaagtgatcctcccacctttttttttttttttttttgagacggagtttcactcctgttgctcaggctggagtacaatggtgcaatcttggctcaccacaacctccgcctcccaggttcaagcaattctcctgcctcagcctcccgagtagttgggattacaggcatgcaccaccacgcctggctaattttgtatttttagtagagatgggttttctccatgttgaggctggtctcgaactcctgacctcaggtgatccacccgccttggcctcccaaagtgctgggattacaggcgtgagccactgcgcccggccctcccacctctcaactactgctctaaattcccttcagtaataagatgcagtcagaaatgggaaaccccatacattgctatttataaatgtaaaacggtacagccactttagaagaatagttctgcagtttcttaaaatgttaaacataaatttcccatatgtagaaagaacccagcaatatcactcctaggtacctacccaagataaatgaaataatatgcctacaaaagacttttaggcaagtgctcacagcagcattaatcacaataacccaaaactggaaacaacccagatgtccatcaactggtgagtaaattaacaaaataggttaaaaaaaatgataaacaggccgggtgcggtggctcacgcctataatcccagcattttgggaggctgaggcaggtggatcacaaggttaggagatcgacaccatcctggccaacatggtgaaaccccatctctactaaaatacaaaaaattagcctggcgtggtggcacacacctgtagtcccagctactcgggaggctgaggcaggggaatcacttgagcccaggaggcggaggttgcagtgagccgagatcgcgccactgcactccagcctgggcaacagagcgagactctgtcttaaaaaaataaataaataaataaataataagaataagaataaacatacagtggaatacaattcagcaaaatcaaggaacagaacactgaaatatgctataacacacatgagcctcgaaaacatgctaagtgaaagatgcccaatgccagagaccacatgttatgtaatttcacaatatcagaagaacaaaatctatgagacagaaaatagatgactggttttgggactggtgatgagaaatgcaagaactacgaagaagcacaagcgatcttgttagggtgataaatctgttcttaagttgggttctggtgatggttccacaattctaaatttatgaaaattcattaaattgttcattcaaaatgggtgaattttatgatacgtaaattatacctcaagggagcttttttaaaaataaaaatataaactctaaaaatttaaaaagaaaataattagaaaaaaagaaatgggctgggcatggtggctcacccctgtaatcccaacactttgagaggctgaggcaggtggatcatgaggtcaggatttcgagaccagcctggccaacatggtgaaaccccatctctactaaaaataaaaaaaattagttgggcatggtggcgggcacctgtaatcccagctacttgggagactgaggcaggagaattgcttgaacccgggaggcagaggttgcagtgagcctagatcgcaccactgcactccagcctgggcgacagagcaagactccgactccggggaaaaaaaaaaaaagaaaaagaaatgaccattgtacttgctgaacacttgatcatgatgtcatttagtctttgcaaaatggcctccgttctccctcctcaagtgctatgatgtcacctcaggcacaggaattttcattcttttaaaacagggtctgacatgcaggagccactcagtaaatactcgctgcatagagcaagatgggcgacaggcagacacggattcatatcttgactcagttattgcagaatcatcagtttacttatatgacttaaatatattacaatgagtaataatacctatggcagacgttgctatttggctccccaatatctgtttcaattcccctctcttgccaccttccactatagcagctgggaaaagttactttctcagaggccccttgcagccaggtgtggctcattagactttaaatgactgtgtgtgtcattgtcgttggggatggagcgttaggagagtgattctggaaaacatttttactctactgataaaacgaacagtgcagctgatgccatttctgcttccttcttcctgacttgaatgtagatgtgatttaaggaatgcagcagccattttgtggccatgtggaaaatatcacaaaacaagaagttctggcctgtcattgctttggtttataactctttccttttgggtctcccaaaccatatctaagttctattattacatgactggaagagtgaggggcacctctggacagcccctgctttagcctcagttctaaatatccacttagtccctcttttcatggattcattggaaaatccgaaagcagcagtcccaatgggaaataaatgggtctaatttcagaaaagacaagcccatttctcttctccccagcaatctcataatactatggtaataaccaataatgatagcaggtaattaatacatattcaccacgatcaatgtctctcaccataatcccattcgtctatccatgatctttgtggaagaggaaaatttcactgtgagatattccagaaacaagcaaatggtccttccactggctgcctcaatgtcaattctctctgttctttcagaacaggaagtcagaacaccaagcaatcacaacagcatgaaggtctcctgccttgctctacagagggacatctattgttctgacctccagcaggtttgatttaaactgacagagacaggttccctttaggcacctgggagaatcatgatgcagaaggtcctggaatctgatggtaatttccagttagtgatcaggcagaatgaaatccatggtgcagtaggatgcactcctagaagacagctgagattaaagaatgggacatggagctgggcacggtggctcacgcctgtaatcccagcactttgggaggccaaggcgagcacatcacctgaggtcaggagttcgagaccagcctggccaacatggtgaaactccgtctctactaaaaatacaaaaattagccaggtgtggtgatgtgcacctataatcccagctacttgggaggctgaggcaggagaattgcttgaaccccggaggtggatgttggatgttgcagtgagccaagattgtgccactgcactccagcctaggtgacagtgagacttggtctcaaaaaaaaaaaaaaaaaaaaaaaggacatgggaagaagaattgggagagagtagcgagcagcttctgacatggcctccaaggacccccaccccctggtagtcttgcccttgtgaaatcccctccccttgcatgtgggccagaccaagtgactcacttctaacaaacagaatatggctaaagggatgtcatttctggtattcggtgtcttagtccatgtagactgctataacagaataccagagactgggtggcttataaacaacagaaatagttctttctcagctcacagtaagtctacaatcaagatgatactggcagattcagcgtctgatgagaactcacttcctagttcaccaatgggcgtcttttcactgcatcctcaggagacagaagaggctaggaacttccctggggtcccttttaaaagggcactaatcccattcatgagggccctgtcctcattaactaatcacctctcaaaggccctacctcctagtaccatcgtcttgggcattgatttgaacataggaattttgaggggccataaactttaatccaaggcattggattacaaaagactgatttccatcctattattctgtctctagctctactcgtgcttgctgtctcatggtgagaaccacattgcaaggagttgagagcagcctcgggctaacagccaccaagaaactgaggccctcatgctgacatctcatgaactaaatcctaccaaaaagcagagtgggcttgggaacagatactgtcctagttgaacctgaagacgattaaggccccaggtgacaccttgatgaagccagtgagaggccctcaagcacaggacccagccaagctattcccagatcctccacccacagacactgtgtctttaaaaactgctaagtaggccgggcgtggtggctcacgcctgtaatcccagcactttgggaggccgagacgggcggatcacgaggtcaggagatggagaccatcctggctaacacggtgaaaccccgtctctactaaaaatacaaaaaattagccaggcatggtggtgggcacctgtagtcccagctactcgggaggctgaggcaggagaatggcatgaacccgggaggcagagctcgcagtgagccgagatcgcgccactgcactccagcctgggcgacagagcgagactctgtctcaaaaaaaaaaaaaaactgctaagtgttgaggtcctttgttaccacagcaattgacgcctaatacagggaatgagtcatggggatattttttaaatgaaaaaaactccacatacacatgaatgaatgagtactcacaacctttcccttttccacactctaaaagggtttttggttcattctgtttgggggttgtttttgtttgattccgctttgggggttttgccttttgtttctttgtgctcaagcagctgctgatcaaatctgagcatttcctgtgttaatgagaacagtattggtaattattattatgctaatatttcatcagcgcttatagcaagccctgtgctgagctttgtaagcctcacaacaacccagtgaaaaaaggtaccagcattattcttcttttgacatttgaaccagagcaactccatcttgaataggagctggctaaaatgaggctgaggtccaccgggctgcattcccagacagttaaggcattctaagtcacgggatgagataggaggttggcacaagatacaggtcataaagaccttgctgaaaaaacaggttgcagtaaagaagccggccaaagcccaccaaaccaagatggcaagggagtgacatctggttgtcctcactgctacgctcccagcagcccgtgacagtttacaaatatcatggtaacgtcaggaagttaccctatatggtgtaaaaaggggtggcatgaaaaattcaccccttgtttagcacataatcaagaaataaccataaaaataggcaaccagcagcccttggggctgctctatggagtagccattcttttattcctgtactttctcgataaacttgctttccccttactctagggacttgccctgaattctgtcttgcacgagatccaagaaccctctcttggggtttggatcaggacctctttccggtaacactttcacacgtgaggacatggaggtttagagtgactattcttgcctgtgtcacttaactggttagttgtggagccaaggtacaaacccagggaacaagactctacctcttcaccatatcactgagctggacagagctgaagcagggaaaagtgacagaaaggctagaatgacttaccctggaaaggtcagggagcttctctgacagattaaagaaatatttaaaaggatacagtaaggggacatggaacacaagagctgcccacagctaagtttatgagaaaagtcagaaggagggagatttggaagaaactaataaggaattggactcactgcccagcaggctaaaggagctggaaaagggagagagggaagatagatgatagcaaagaaagaagggagagggaggcaaagaaagtgagggaggggagagattgattaatttagttatacataatcctgtgcatgagccctttcagcagttttaagagatgcagtcaacactgaagctgagaggtgaagccagctgggcttgtgggttaggtggggacttggagaacttttatgtctggctaaaggattgtaaatgcaccaatcagcactctgtcaaaacggaccaatcagcactctgtcaaaacggaccaatcagcactctgtaaaacagaccaatcagcactctgtaaaatggaccaatcagcaagatatgggtggggccaaataagggaataaaagcaggccacacgagccatccgcggcagtaggctgtggaaggtagttcttttctgttttgcgataaatattgttgctgctcactagttgggtctgcactacgtttatgagctgtaacactcgctgagaagttctgcagctttcctcttgaagtcagtgagaccacgaactcaccagaaggaagaaactctggatacatctgaacatctgaaggaacaaaccccggacccaccatctttaagaactgtaacactcactgtgagggtcagcggcttcatcctttaagtgagcgagaccaagaacccaccagaaggaaccaattccggacacaaaactattttcactgtacgagatgggcactgcaccaggatcacttttgctcccttcattctaggagtttctctgtgtatcgtttctaagatgccctctatttctttgactgttctttgtcttctgtgtggatctgagcttattcttaattatctcccattgatgccactgtcaccaacccagtcccaaccctcaccttgtctctcctgcattatttcaacagtctccaagaaagccttcctgcctccagtcctatccatggccttccttttttgtagactagtgccaagcaatgtaactgaagagacaaatctaaccaggatgttgctctgcttatttaaaccatcactgattccctgtttcacacagaatcaattccaagcttcaaatcattatggaaaagatcaccacctcttgtttgggctacagcaatcgtctctaagtggaacaccaagcagtaaacagtaaatcccttcctcacctcctgaccaccacccccccctgccccgggggcaggatacctctgcagaatggaaaagcaatcatgtcccttccttaaacttccagaggtgtggtatgcatgtgtaagcattacacattgcaggctcaagcttcatcctgtacaatttgcaagtaaaaaaaaaaaaaggcagcaaactttattttccccgatttcatcttgctgcaagcaccattctgctaggtagtatgaaaaacactaaacatgccagttttgatatcgtcatctcaggaagtttaaaacggccttcagttagtacagactctttaagataaatattcaatcatcccaaagatttaaactccgtaccagggctgtttcttccacacaatgtcacacgggtataagaaaatgtgtgtgtgtctttggattagaaggaggcctcaagtctaccagacacatcttgggacttctctggttttttcaacagtacaggcagactggcccatcgctgctgtctctcaatgtttggggtatcacaggaggaggacttgttgaattctgtgattctggccactctcctcgtgttacaaagtccctatctacagagtccttgctctgaccccagtggcagtccatgggttctctcagaatctccacatcactctgcagggatccaggctgcagggaacccgtccacccgcattccttcgcaaaactgaagggggtttcctaaaggatggggaagtgaaaatattcactttgtaccacagaaaatgaagaaagtgcccaaccgtgctctgaaaggcctcaagacttagcttccagttttgtacatcacttctagcgtatcgtcttagagagggcagtcaagacacgtatatttcagcatttttcttttttcaagacagagtctcactctgtcacccagactggagtgcagtggtgtgattttggctcactgcaacctttgcctcccaggttcaagtgattctcctgtctcagcctcctgagtagctgagactacaggcatgcacaaccatgcccggctaatttttgtatatttagtagatatggggtctcactgtgttggctagactggtctcaaactcttgacctcaggagatccacccgcctcagcctcccaaagtgctgggattacaggcgtgagccacctcacctggccagcatttgtttcttttgacttcaggtcctctctgaggaccaaagagccttcctcttgccactcagcacttcctctagcgcctccaggagctggggcatgaggaggatctgtcatgaaactctatggtctaagttggccaggcttgcacattggtatgcgaaaaggccttttggaatttagaaagggcaaacaaatgcagaagcatttatcttgtaataaagtttggctttaaagataattgtcttgccatttcctggagaaaaaaaaataagtcatctttgaaactcaacattgaatgatgagctttgttccattccatagcgtcctctccttccctagggcaatgtctcatggcttagcttttgtaacacaaggagtgccgagaagaaagaaactggctgttaagggagtaattaatcaccaagaggtatttcaaaaacattaaacctatcatatttgttgtgtgtacagtttgtacatatgtgtgtgtttgtgtgtatttgtacacaaatggtccatgttctacaccatgggtttccaaactatgccccacagtccaagtccagcctgcctcctattttttgttgttgttattttagtgtgttttacaatttttttaaattgtgttgaaatacacataacaggctgggcatggtggctcaggctgtaaacccagcactttgggaggccgaggcaggtggatcacgaggtcaacagttggagaccagcctggccaacatggtgaaaccccatctctactaaaaatacaaaaattagccaggcatagtgctgtgcaccctgtaatcccaggtacttgggaggctgaggcaggagaattgcttgaacccgggaagcagaggttgcagtgacgtgagatcatgccactgtactccagcccgggtgacagagcaggactccatcttgggaaaaaaaaacacacacacacacacaacataaaatttaccatctaagtcattttaagtgtacagttcagtgtctttaaacacactcataatgttgtacaaccatcaccaccatccaactctgcaattcttttcctcttgtaaaactgaaactccatacccattaaacaactccccattttccccttccctcaagcccaacaaccaccattctattgtctctatgaatttgaatataagtacctcatacaaatagaatcgtacagtgtttgtcttttgtgactcgcttgtttcacatggcataatatcctcaaaattcatccatgttgtaatgtatgtcaggatttcctaaggctgaacaatagcctattatacatacgtacgtagcacatcttgcttattcatccatcagtggatgctctcacattttagctattgtgaataaggttgccacggaagtcgatgtaaaaataatccctttgagaccctgctttcatttaattattttttggtatggctagcaagccgagaatgatttttacattttcagatgattgaggggagggggaacaaaagaagaagagtatttggtgacatatgaacaacttttgaaattccaagttcaatatgtatgaagttttattggaacacagccatatgaattcctttgtgtgtcgtccatcgttgctttcacacacgagaaaagaaaccatacagaccacaaagcctcttactatctggtcttttaagaaaaagtttgccaaccccttttgtatactggttggcactttgtttttttatcttaaacatatgttggagatcatttcatatcatactcctcctacttgagtctacttctttcaaaaaggttgtttcagaaatttgctgttacaaacaacaccataatgaatattctaagacatctagccttctatatataacatgtctctctctgaacctcccatcccctacatacacacagacacagacacacagacacacacagagacaaccatgagccccttgaaaacagtgacctcatctatttatctttatggttccagagcagaactaaagaaaaacatcaattgctttctttcaatacatttgtttttttataaacataaaattaaagactacttagaatcctctcaaagttgaacatggttcaaacaaaagaatttgaacttgagaaaatcctgcatttttttagtatggaaatctatcttctccaccattctttgtattcctatttgtctcctctgccttcttttttttttttttttttttagcaatttgacttatgtttagcagccattccccaagatagcatattcctctgtgacaagatttaattaaacttccagcaaaataattagcaaggctatcttaaaagaccattttaaaataccagagtgataccaaggagtgaatagagttaacactgtcatcagagatcaaagccatcagaagacgtgactgaaaatttaacctccagcagccgcctgatgaagaggtacacattggaacagttgtgatagcctctctctcgggtcccatcgacaaattcatttgacatggaaaatttcccaaaggaagcttaaaaatggtaaatttccattaattacatagcaaagaatgtactcttcatattttattatccattaggaaactttggaggaaggtgtaactgcctcttataatgtagactatccttctttacttggggatactgatgagattagcaaacagcttctcaactaatgtgaagacttatttggagaaagacactttgtaaaaactaccttgactgtgatggtggtgaccctgggaatggttgtggtggctatcttggcgaagagccccatggcgatggtgacaattccaaggctattagcttggtgcaaaattgcagttgtcattaaagtaataccaattcaggacctactaccctccacctggaatctcggagagaatgaaaaaagctgaagggatccaaagctagaagacttatgttcgagcctctgctccaccagtcagtcactctgtggtcacgaggaagtcccttttcctctttaaacctcattattcacctgtacactggctatctggtatggtttggacctgttcccctgcaaatctcttatcaaattataattcccaatattggaggtagggactggtgggaggtgactggatcatgggggcagtttctcatggtttaacaccttcccctttggtgctgtcattgagatagcgagttctcatgagatctagttgtttgaaaagtgtgcaaaacctccccactctctctcttcctcttgctctggccatgtgaggtgcttactccccctttgtcttccaccatgactgtaagtttcctgaggacttcccagaagctaagcagatgccagcatcatgcttcctgtacagcctgtggaactgtgagccaattaaacctcttttctttataaattacctagtctcaggtattttttatagctgtgtgagaatggactaatacggtgtcatactctcctccttacctgttttgcacagttgtgaggataacaagagatgttgttgatactcagtgtgatggtgactatagtgattctatacagcaaatcctattcttgtctttttcaccgtcttccatgaacatatccacctacaggcagccccaagagatctagaagtggaagaacaaaggccagattctggttactttgcaattaacacagagatatgggggctctcatttcttccttacaggtcaatagctcaatatggtaccttaattcttttcctgtgttaggaatatattcataaagccttatttactctttggagatgtagtatgaagtacttccaaacagtactacttccaataattggtggtgaccaattattgctctttttatctctaaaaaactaagaaaatcctagttatcatttcataaagagatattaagactggatatttaagcatttattgtgtatcggccatggcactgagtacctttgaagccagtatcattattattctccattttatgaataaggaagttaaggatggtgcatatttttctgcacctgcaatcttttaaaaaaaaaaaatccctgcctcacacccactatgcccttcccctctacctcagtcactgttgttcctcttaccaacatcaactgccccatgaatcagagatctacagaccctgttcctagtaacacaccttaataagcacttaaacagtccaatggactagcgcatgtaatggacctagcttgttacaaaaaccacaatgaccgtttagtacatggtagctgcaatctagccctgtggtccaattcaggagcttggaattctgcattcttggttcaaaccacttataagaagaaagaccttagccaaccaacgttgtcatttcttcaagactcgagttcttcatggagataacaatatatccactcactgggttgttgggaggattaaatgggttagatacatgtaatgtgcttcggaccctatctggtactgtaagcagcccatacatgcaacttccactactattatttcctgacaatgcaaagcttctattaagtgagtttttttctcctgatgtgctgtgttcattccagataaaccaaattaaccttaggaagcttattacctttaaatcttgattgcaaacatgctccctcccctctggcaagactctctcatcctctcaaatcctctgttaatatttctgattatttttttcttaaatagggttagattgttttcctcccaacaagctcagtagaaaaatagacatgagggaaaatctgttttagccattagctgtgtctctaatgctgccagcgacctcggtggggcccttgctgaccctccttacctcccatctgcatgcagatttcctttaattttaataaaaacagtaggaggtcaatcgaccacagcctgtgacctcgccaacaaaacaagcccccaacatgggactcaaagttcagggagcttccaagtgcaatttaaaataaatgctcacatagagctatggtcagcactcggaatttgtctcaaagtgatttgcatatttagaacaatattctccaatgctttggcccattggggagtgatttgcattcagggaggaaaggctaatattctagtcttagcaattattgaaacacatccagtcggtactctaataaattatcttaacccaattactaaaaacattgcaaaacattactgtgcatggaagaccgttctgcccaggaatctttattggcagggtaattaaaagcgtactagctatggcttctgctcaaatatttggggatgttttgtgccatttgaattagctctcttggactgagaaaagagatatctgacaactacttgctttatttatctctgccttccccacctccttgctttggggaccactcataattaaggtccccttcccacatcaatgccacctacaacttccttcctaccctaatcctccttgcagaaaaaagtacttacataggcccagtccctccccttcatgcctgctatcttttatcaaagcaaaagattttgttagccattatgtagtgggtgcctgctatacatcagaagcttctgcattatgagaataaatcctacagtaacatttcggggaatggtattcctattccatgcatgagaaaagtgaggattaaaaggttaagtgaatttccaaagttcgcacagctgatgagttgcaagatcaggatcaaactaagggctggtggttccaaggtcctcctttccttccccaacaaggatttatccactgcttatatgtgccaggtaccatgctaggccctgggaataaggtaggaacgacatcaggcagactccctgcccttgcagatttttgtatccattcatccatcctgtgtatcagtcagggtacctcagttatgctgatgtaacaagcccaaaatctcaatgggaagtaacaaacatggctttctcattcatgcttcatgtccatgagggttgacttagcaattcacatgtccacatctacctttaaagtaggtgggaaaatataatcctaccagaggactggaagtcagaaagttggaaatatttgataaaaagcattaatgacaacctcagctcctgtgacaaaggggaaggagtcctttttcagaacaggagctaggagctctccagtgaatttacaatcaagctgcaaagctggccgagttccccagcactctacatacaaatccgacattcatctccaaacaccatctttgtcagaccacagagacccctggcatcaaaccctgccatgatcacagggacatgcaacacacactccctcataattaggctcatcttcacaccccccagcatgcgccaggcagctggaccctgagccaagatatgagggtgcaaatgaatccagcctggagcatagaacagaggtggccagggccgctctgcctgttgaattaactctttagaatcacttttttttttctagatctgggcgtctttggcagacagccacacagatatggttctccctccatctcattaatgacatggtttgctgtaagttctcctttcaccacagcctagacactgggctcaaatacatcatctaatttaatctgcacaatgatgcagacaggaatatactaatgacttcattttacagataaagacacaggatctgaaagatgaaagaaacagctcaaaaagtggcagagcaagcctttgaacccaagtctttgtgattcctgaatacacagcagcctggagctgccagattcttggtcaggagcatcataataaagactctgactccatgaccctttgtgtcatgggctaaccaggacaagagacaaacaaaatgttccaggatccaaaccagaagtgactgatcccaattctagtccaaatcccccggcatgcaacgtgaaaaaaagaaactaattttcaagcacctactttgggccaggacaccagacaagtccagactgtgaatccccgtagtgcacatgggctaggcccacagtatcaccacatttaatctttccaacatcattgcaacttgaatattttaaggataagaaatctaagtctcagaggggatgagcagcttgcacaaggccatacagcctgtaggaggcagagctcatacatgaattctgtgctgcccaacttcatgttttctactccactatgatgcttgtttttaaatcccaggagaaagccaggaatgcctgttgggaagattcccacacacacgactcacacaaacatgggcttttctatgattgtctcagaaatagcacagcatcaacccggaaatagatttgaggtcttcccccaagttgaagtatgcctcactccaaaccaagtccattagtttgctaggggatcgcaataacattaccaacaacagaaataggaagaagaggaggacagacaaaaagaaggatgaaagaaaaaggggaagaggaaagaagatggaagaagagacaggagaaagatggagaaggaaggatgaagaggagaaggaggaagaagaggaagaaagaggcaggaagaaagaccattatcaccctccccccgcccaccaccaccgtaattaaacattaagtactaggctctgttcagagactttatgtgcaccagctcataaatctttcccagaaagctccaaaaggtagggagtactattattcccattttacagacaagcagaatgaggctcagaaaggtcaggaattcttcccaagatcagccagctactaggtggaagagccaagcttcaaacctacgtctgaatgcaaaatccattccattaaccagctcctgcatcttcctctgaagaaaagcaggaagagcttcatgtggaccagggcttcaggggacataaccatgcttcctgccaggaaaaaaagaaaaaaaaaaaaaagtaggaacagggttggttagtttccaaagaggattcctgttcaacattctgcttgctgcctccccaccctcctcttggtgccccactgaaatttcttttctggtggccacgtccctccccagctgctccccgtgacggccaagagcaactggcatctgattatggcccccctctagagaactgcttcattcctcacatcaaggtggggctatctctgtgctacatttgagcccagaactccccaagggaccagtgtgaagcttctccccatccttgctcagctcctccttcccctttctcctgaaaacactccccggataaactgcttgcccccgaatccctgtcttgggctctgtgtctggagaattggaccttaaccccacgtctcctgctcccatctctgcctctgctcacttggggctcttggacaccagcttctgacttctgctactcggcctcagaggtgggagaaacaggggagaaggcaaagtgaggcactcagggagccaaggaggctggaggcacaaaggcaggcggctgagggggcagccagctcgaccacgcaggcagtgcccggccgcccccacgtcagcctgcccttggcctcgtgcactttggataattaagaacagatggcccatcgccttggccaagcctcattaactccttaatgccgttcttctggaggccggatggtcagccggaaaagctcgctttggaggtcatctgattaaatgatgcccggccagagggctgcccagtccctcttctcaggctggcagctgccccggttgcttcattagagctgccattgtgaccagatgggccaggaaaggggctggggtgtgcttaagtgaggggaatgcgctgagtgaaaaggcttaggagtcagggaacattgccctgaggcattgggcaagtcacttaatctaagtctcagtttcatcacctcccaaatggctacagtcatagcaataacagggccaggcacagtggctcgtgcctgtaatctcagtactttgggatgccaaggtggaaggagcacttaagccaggcattcaagaccatcctgggcaacgtagcagtaccctgtctctatgaaaaacaaacaaacaaaaaaaatagctgggcatggaggttcacacttgtagtcccagctactcaggaggctgaggtgggaggattacttgagcccaggagtccaaggctgcagtgagctatgatcacaccactgcactacagctgtataatcaccactgtagcctgggcaacagagtaagaccctgcatgtaaaaaaactattttaaacaataatagttgtaatatttttctaatggcgattattttttcaataataattattctagtaataaaaataatgtgccaaacactttacatgtcatctcagttactcttcacaactgccctttgagatggtacctcttatgatctgtactttatgcatgagaaaagctgaggctcagagaagctaagtaacttgccaagtttacatacctggcaagagtcaggcagaatttgaacccagttctggacgattccagggtgcctgatcttcaccactgttttggcctgctataacaaaatatcataaactgggtggcttgtaaatagtagagatttatttcccacagttctggaggctgtagagtccaaggtcatggtgctacaggatagagggtcctaaacatggtagaagggcaaataagctcccttgggcctcttttttgaaagggcattaattccattcatgtgggccccatcctcatgatgtaattatttcctaaaggcaccaactcttaatactattgcattgggaatcaggcttcagcatctgtattttagggagacaaaaacactcagaccacagcaaccagcctgcctgtcttacagggagatacccgtctcaaaggaaaacaagaagctacaaaagcattccctagtccttggcacaggaaaaaatctttgactccctccaaagaaaactttaaaacccatattctttattttgtctatttttcacccagactatcttctcaaacctaaaaatcctaggcttatattgaaaacttcaggtccccattgtggaaaagagtgtggcaattcctcaaagatctagaaccagaattaccatttgacccagcaatccccttgctggatatatacacaaaggaatataaatcattctgttacaaagatacatgtacatgtatgttcgtggcagcagtattcacaatagcgaagacatggaatccacccaaatgcccatcaatgatagactggataaagaaagcatggtacatatacaccatggaatactaggcagccataaaaaggaatgagatgatgtcctttgcagggacatagatggagctggaagccattatcctcagcaaactaacacagaaacagaaaaccaagcgccccatgttctcacttataagtgggaactgaacaataagaacacttggacacagggaggggaaaaacacactggggcctgtcggggatggggtcgggttagggagagcattaggaaaaatagctagtgcatgctgggctgaataccaggtgatgggttaataggtgcagcaaaccaccatggcatgcgtttacctatgtaacaaacctgcacatcctgcacatgtaccccagaacttaaaaataacttttttttgtaaagaaaactccaggttccttgcaatgcttctagctacctggaacaagggaaagaggacacatgcacatctacacattttggataaagttgactaaggagaagactgagaactgaccacgtctttggtcaatgaaagaacccaagaagcttacacacttgtgcctcatttgagaatcctgggcacgttaggagagcggcaggtgggcagaacatgggcaacagatgtgggactcggggaaaagcatacggctgaacttgagggagcaggaacccactttctacacacaaccttgggattggctgactccagcaggatctggtgcctgcgtctgggcacaagcaccagagacccacaaaggaatggttaattctagtctctgcttttgaaattctaaagtgctgtgccagaaaatgttttatttcttgagctagataattgttccatgggtgtgttctgtttgtgaaaattcattgagctgcttacttatgtgaatgtacttttctgtttgtacagtatacttcagaaaagagtttttaaatgaaagaaaaatgcctctgatgaaaaacagaaagtgcttgggaaagcccaaactgctactcaggttaactgttttgatgttgttagcatgttttaagcccctcctcacccttatccagcaagtctgttcctcatcttaaaacaaatgggcactcagcttgctgaatattggcttgcttttgtctccacatctgtgcaggagagttcccccaaaaccacctctggaagagttcatgagcatcttacaggcaagactttattactctgtattctccaaaggcctttacatgacaaagatgttctcttccctcatcactttcgctccttgaagatggagacgatgacatggtttaagcaactggatggagttcctcattctggcaatcacaagattcgttgccaaaaatgctgaatgctcagagcattgagcttcctccaacccactcctcatcccaagcatcttctccatattctctgcttttgacttgacttctaagtccagtttgctaattccatttggatctgctaattcttctttccattgttccccacctcctccaacttcaaatcactctctcctccagtggttcccatcacaattagccttcaaccagttgtccaaggcaaaacctcagaatctccctagattctgccctctcccttacatgtaatatttaggtcctgaacccatctgcttctccttacctccacaggcatcactgcgatccaggccacctctatgattaccatagctcccaacttaccctcctttcaaactaccctacatccaacagctaggataagctttattattattattattattattattattattattattattatactttaagttctgggatacaagtgcagaacgtgcaggtctgttacgtaggtatacatgtgccatggtggtttgctgcacctatcaacccatcatctaggtcttaagccccgcatgcattaggtaatcgtcctaatgctctccctccccttcccccacaaacccccgacaagccccggtgtgtgatgttccccttcctgtgtccatgtgttctcattgttcaactcccacttatgagtgagaacatgtggtgtttggttttctgttcctgggttagtttgctgagaatgatggtttccagcttcatccatgtccctgcaaaggacatgaaccagaatgagccttttaaaatgtaaatctgatgaaagaagttccctgctctgatcctacaatggccttcccatctcacttacgtgtgatcacccttgcaagacctagacaggttgatatctgcttaaccacctccagaccagcctctcactcagccccaatagcagaggcgaatttccatttcttgatcacactcaactcatgactcacgtccaatatacatataccttttgcagatgctgttcccttgcctgcaacactttacccttggcttttccatagctggtgacttttcatgtttcaggtctcaaagaaaggtgacctcctcagagaagccttccttgaccacccatctaaattgctgtccaattattcttcattgcatcttctcgtcttatctccctcatagcacttaatcagaagctggtattttttatttgcttactgtactatctgtcttttgcccaaatagtaaggaccatgacaccagaggccctatcttattcaatgctgagcccctggtgtgtggcatgcagtcagggcttttttttttttttttttgagacagagtcttgctctgtctcccaggctggtgtaatctcggctcactgcaacctccgcctcctgggttcaagcagttttcctgcctcagccgagtagctgggactacaggcgcacgccgccatgactggctaaatttttttgtactttagtcgagatggggtttcaccatgttgcccaggctggtctccaactcctcagctcaggcaatctgcctgcctcagcctctcaaagtgctaggattacaggcgtgagccaccgcgcccagcaggacttgttgaatgaatacacctggcattctccccagcgtcactcacccagactgcctgcaagagacatacctggccctgacccacccccttcctgccatcccaattaaagaagggaaattggacatgaaataatgactcctgattcttcccgggctgctttggcttccttaacctcactcctcgcactcaaatttccaaaaccaacagaaagagcaaggtccttctggactcaggcctgcgttactcttttccaagtatttgtggtcatctaggctcatcccacatttcctattacactggaaaccaagaggtagccaaataatatggtaaatcaaagagtctgggctcgggagttaaaagcacctaaggtcgaattctggccgcatcctatttattagttatttgttctttttttttttttttttttttttttagacggagtctcgctctgtcacccaggctggagtgcagtggcgcgatctctgctcattacaagttccgcctcccgggttcacgccatcctcctgcctcagcctcccgagtagctgggactacaggcgcccgccaccacgcctggctaattttttgtatttttagtagagacggggtttcaccacgttagccaggatggtctccatctcctgacctcgggatccgcccgcctcggcctcccaaagtgctgggattacaggcgtgagcgaccgcgcccggctagttatttgttcttatactaatccttatcagcctccatttctccttctggaaaataacaagaattctgtctccctcaagacagagtctgtggcattgtggaattatttaggggtcaaccatttcaacgaatgctacatgaaatctatctagagagtggcacaaagaactcaataaatgcttttgtaattaattctaatttctcccagaagctggcatgtctcagcttacattttccttcctctgagaagattcgtttaactccaccaccctctaagtctgggttagatgcttctcctaagtatagatctggaaccctgtactcagtgggttctgtggatccccactgcattacaagtaaagctaagtccctacaccagcctatgagatgccacgtaacagagtccccatcctgcctctggccctgccctcgccactctccccatcattccctctgctgcagccacattggcctcatgcggttcctcaaacttcccagactctcacccactattccctcttcttagagcatgctcccccggctatttacccagttccctccctcatcccctcaggaccctcatcaaatagctcctcagtgaggctttccttggccagtggaaggctgaataatggctccccaaagacgtccacatcctaatccccagaatctgtgaccatgttacctttacatggcaaaaggaactttgcagctgtgattaacaaggatctttaaatgaggagtttgttctagattatccaggtggtttcaatggaatcacaagagtccttttacgagggaagcaggaaggacagagtcagagagagagcgagtgattggaagatgctaagatgctggctttgaagtggaggatgaggctatgagccaaggaatgtggatggccttcagaagctagaaaagccaagaaaacagattctcccctacagcctccagaaggaacgcaggcctgctgacctctttcaattttttttttttttgaggtggaatcttgctctgttgcccaggctggagcacagtggcatgatctcggctcactgcaacttcggcctcccaggttcaagtgattcttctgcctcagtctcctgagtagctgggattacaggtactcgccaccatgcccggttactttttgtatttttagtagaaacggagtttcaccctgttggccaggctggtctcgaactcctgacctcaagtgatctgcctgcctcggcctcccaaagtgctgggattacaggcgtgaggcaccacacacggctcaaatttttgacttccagaactataatgtaatatatttgtgttatcttaagccactaaatttgtggtaattcattacagcagtgatagaaaaaaagttcagccaccaaatctaaaattatattctccaccaattgtgcacatgtgtatgtatttgcataaaacacacatgcatgtgcactcacacaaaacacacacagacactccttatccctctgtcttgatttagttttcttcattcatctgaccaccaaaataaataagaaaaatagggcacatgtctcccacacgtacatacacacatacacacagagaaatgagatttccacgaagacactgatttgtggctatgtcttgtgtctctttttgtcactgttgagttccttgcacctagaaactggcctggcattattgagtgaatagagactcattaagttttgactgcatgctttatcttagaacatagacatacattctgttattatttgtacaaaatctctccacctgtcaactcttagcccttgaggtcagggacccatctctcttcctcactgctgtatcattccatcattagcacagcaccctatcctcccacaagagccccacgaacatgtgctaagccattgggccaacgctaccacattccacacatctgagccccagagttgtcagaattccaacccatcaagagacctcgcattttatttgattgcaaatatgtctaattcccggttcactcgagcagcaagaaaaaaaaaagccactcgagtctgtaatttacaaagcaaatctgcccagcagaaatattcatcttcagaagacagtgggattcaatcattttttaaaaggggaaaagaaagaaacttaacctgtttctcccatgttccagttgcatcgtttgcaaaacttttgaaagccctttgaggccagggctaatcattttgcttccaggggctcatttcctgaggtgggtggtacctttgtcaccaaggaaggaacgcagcaggcaggaaaactgagattgtggcagaagtcattcttggggaaaggatgtatgaagatctagtcaattccacccggcttgctaattagagtttcagaaatacagagatgctgtgtccctttgaaatccttagaatagttggatgaacaagcctgtcccctaagggaatgtgcaaggacgtatttaaattacgttatttttactttaaataaccaagtcgaaagagttggtgactggaagttaaattaggcaagtctagggataatgagtatgtattagacgcccctccttttccatttcctctctcatggatccatctcatccttgtctatttcctgcccaatctgtgggcctctaaaggataaggaccatgtgctatttgtctttgcatttctggcagtcattatagtcccatgatagtgcctgacacatgctagacactgtgttgaattcttaaatagatgcccagatgaatgaatgagcggatgactgaatgaacagatggatagatggatggatgagtgtttgaaactggaaatgagtatgcctgtaccaaatgcctgtgtcccaacttgcttgataaccatccaggatgtttgttttatctacagcttctcaggcccctccccaagtggttctgattcagcctatctcaaagttaacctgggaatatgttcttgaacattttccccatgtagctccgatcatcaggcatgcttgggaaacacatgccatctccatctgtttcatgcttccttacctgaaatgtccttatgttttattcaccaccccagggtaatcttcagcaggtgaagtttctcacattcaaaatgggaatcagggcctcttcatgtctagctacttcctactccctctccactgccattcaccccttccaaatgcagtcttatttttctattctcactctcttccccagagctttcaaagatttctaacataagaccgagatagcagagcccccagggtcagcattctgcctgacagccgtgcagcaacacggactggattccctggaaggttttgcgtctaaaagcagggcctcgtggctctcaggattcccttgcatgcagcacccatccttcctgcccatccactgagtataccaacctaggaaatggaggagatcgaagtgtgtgtttactgtgtctcatgatgcatgttccatgagatggaagatggtctgggcagcgattttcaacctttatgaaccaagcaggctcccgggctccactcttctcaagatgatagggcggtatcttgtttttctaggtttcatagttagacctccctctgcaacatttgatttttttttttaaaaaagggtgccaaggatcaaaaaggctgaaaactgctagtctaaagcatcatttttgagccagtgggccatatttcgacctttctttctcaaggtgccattagaacaagaaggaattgccttttaggacagtgaactaagtactggagttcctgtttacacagaggtgattgaacaaccttaataattcttgcgttaataatctattgctggccgggcgtggaagatcatgcctgttatcccagaattttgggaggctgaggtgggtggatcgcctgacctcagtagtttgagatcagcctgggcaacatggcgaaaccccgtctctaccaaaaacagtaaaaataaaaaataaaaaaaaattagccggatatggtagtgctcacctgtggtcccagctactcgggaggctgaggtgggaggattgcttgagctggggaggtggagactgcaatgagcccagattgcactactgtactccaccgtgggtgactgaatgagaccccatctcaaaaaaataaaaacaaaaaaatctattgcggcataacaaattaccccaaaagttaatacctacaaacatcaatgtttattatctcacagtttccacaagtgaggcacggatttgctgggtcctttcacagtttccaacaaggcggtagccaaggtatctgccgaggttgcaggctcaactgggaagaactcacttcctggatcactcttgtggccgtcggcaggaattagtttctttggggttacgggactgagggcctcagatcttctctcgctgttggccagaggctgccctcggttccttgacacgcacatctctccactgagcagctcatgacgtagcatctggctgccattagaggaggcaagcaagaaaagagtgcgggcaagatggaactcaaggtcttttggaaacctaatcttggaagtgacgtaccatcccctttgctgtgttgagttcatcagaggcaagacgctaggcccagcccatactcgaggggaggaaatcgtatatagacatgaataccaggggaccagtgggagctcttctttttttttctttgagacggagtcttgctccggtgcctggctggagtacagtggcccaatctctgctcactgcaatctctgcctcccgggttcaagcgatttccctgcctcagcctccccagtagcagggactacaggcgtgcaccaccatgcccagctaagtttttgtattttagtagaggcggggtttcaccatgttggccaggatggtctcgatctcctggcctcacgatccacccacttcggcctcccaaagtgctgggattacaagcgtgagccaccacacccggccgggagctcttctaaaagatgtccactgcaccttcaaaagctttgctatcaggtaatcctcggaagtaatgggatatgatgtggtcagccacacctgggttcaaatcttggccctgctacttactagtaccactactgttcataataacaataaccattcctgctattccttgttaagtactgtgcacatcttcacaagtgtcatttcatttgacccccccaaagcatccccttgagaaagtcctttgactatccccagagcatgaataaggaaactaaagattaggggaattcagcaactcaccagacatctcagagctacctctgtaagcagaaaaggccagattccagccacaacgcctctggttctgtgagtctgaagctatactctgaccactggtgtaattcctttgacctccaccaaccgtgaaacagagatgctaacactggtcttcaagggctagtgcagaggatgaggtaagtgaataaaatagtggcccatagtcagaaatcagtaaagggtaggtattttgtttaacaaacatttgccaagcacttcatctgagccaagcattgtgctgatcctgacttttcttttcttttctttttttttgagatggagtctcgctctttcgccaagactggagtgcagtggcgcaatctcggctcactgcaagctccacctcccgggttcacgccattctcctgcctcagcctctccagtagctgggactacaggcgcctgccaccacgcccagctaattttttttttttttttgtattttttagtagagacggggtttcaccattttagccaggatggtcttgatctcctgaccttgtgatccgcccacctcggcctcccaaagtgctgggattacaggcgtaagccaccgcgcctggcgatcctgacttttctcatacagttttgttcagtttccacgccgaccccatgatgtagctggagttaagtgcttacattgacttattcaagccaggctctgtttgagtgctttgtaaaatttcactcattgagccctcaaaatgaccttaggaagcaggtgcttggagcagatgccacaggtggcctcacccgtgtcactgcagggcacacaggttcaacttccagtctccagcacctgcgtttctttgccagggctctctcgggctggtgaaacttgctttatcctcatgtgacaagctgtgccacccctgctccggggacatccttcaacagatgaccagtgccccaggtcactcgtctctcctgaagaactatgagttgtgagttacacaatatctaccagagctgcccagagaaattcctgcctgtgtttcctctgtaggggctggcttcgtagcatatccttcgtgcctgccttctccctacgtgtccctgctcctctacccatgttctctgaaccttccaaataaattacttgcccccaaatccttgtctcagtgtctgcttctgaagaaatccaaatgaaggcagtgttatcatcatcatcatcatccccattttcaaataagcaaagtgtagcacagagaggttaattaacttacccaaggtcacacagctgggaagcagtgaagtcagaattcaaactcaggcagtctgactcttaacattatgcatagtgattacatttttaaaaaattcaacttttattttagccacaggaggtacatgtgcaggttttttacatgggtgtattacacccgggtaacaagcacagtactcaataggtcgtttcacaagccatgcccccttccctctttcccctctctggtagttttcagtgtctattgcacccatgcttaagtccatgtatgctcaatgtttatctcctacttataagcatttttctttctgactgagctgggtaaatggaggagaagagttaccttatggtgccaaggaaaaactgtctacaccaaagctctgtgtgtaaccagtggccgggcatgcaaatggttccatgtattactgcaaagaccagcactcttctctaatgaaaatgtcagctccccaacacagccagctgtgattccattgaaaaatgtgattacggaagccatgctaatggtgttaacatgttgcaaggatttctggtgtgcttgtaaacctaaaaccgtaattgccaaagagaactcgtctcccacaaatcaaacccctctgtattgacaattacatccggtgttgcacggaatttaatgcctaaataatgaagtcgaagaacaatgctggagcctgagcatttgaatatatttgattgattcatttctcgctcccatttaataacccacttagtcagtgacggttaagtgcaccagagagaaaacatttcacagattaataactagatgtgggtacaagctggcgctcccctaatagcagcacaaaaataggttatcgtcaaaaatctggatttaatgttccaaaatggggatttgtgcttttcttttatatggttccatacttattaccacaggctaatgaaacagaaatcaaaaatcaggagctaataaatgcaattccaggggagtattttttttttatttaataccttccaagaccgtgatctttgttcaagatctttaatgctcaaattacaatgtgtgaatattaagcatattcgattatgattgaactctctgaaaagctaatttatgaaccctgcagcctaacacatttgtgccatttaaaaaaggaatatgaccacagttcatttataccaatttctccagtacagagataaacactcctaaactgcctatatgaataaagttatgagactgtaactttattataggctgggatgtgtgatttctgtggagagatatataattaaatgatattgactccgtgtgtaaagcaactttggcagaaattttgcattggggaatgttctcttaagttcctttcttgctgttctagtgaaaaaaaaaaaaaaagtggtcagacaagggaccttactcagggcagactgaaaaaatggggcctcctccctagctgtaattctctttctgcaataatttcatgacctcttgtggaaaaatattttcccctaataaactcagttttaatacaagtttaacaaatccttatccctttatttgttatgagctttactatcttttattatgtttaccatggaatgcccaagccatcaggtataatgagaactgctttgtgtctttccacgtgtccagccagcctggaaggacacatcgatgacactgtgaggaagaataaggaacacgtttctcatgtgctgtgaaatactctggcctggagaggtcctggtccattcattctctgggttattgacttttgccacagcctaatttaaaaaaaaaatgattggccaggcacggtggctcacgcctgtaatcccagcactttggggggccaaggagggtggatcacttgaggtcaggagtttgagaccaggctggccaacataatgaaaccctatctctactaaaaatacaaaaattagccgggcatggtggcagggactcgtaatgccagctactcaggaggctgaggcaggagaattgtttgaacctgggaggcagtttgcagtgagccgagatcgcatcactgcactacagcctgggcgacagagggagattctgtctcaaaagaaaaaaaaaattattgcaaagtgtatatatgataccaatttggtaaaactgaaatgcaaaattaaaactcaggctccagtaaatattagggcaagactgggtaaaatgtaatgcggagatttacttctccagaccctacacatttattccagtgaaggcttttgactcagccccctggcagtcaagatacaaagggacactgcatccattatatgggttccccaggcaaagcagacattgcctggccctgagcatgtattgccactaagctataaagtgcaggtcagggacctagtaactactctccctgcccctactctgccacacacacacacacccacccacccacacacacacacacatatacacatacacacacacacacacacacacacacacacacacatacacacacacactccatgggcaggttccccttgagctcgcactgtctctatgcaattcagtaataaatttatttattactaaacaaatggtgccttcacacaaggaagaagacatctcttcccctagaggacacagccagagaaaacagcttggcaaacaaatcctggcttgatctcagcctctgtgtactcctttggctggatggtgcgcaaggactcggatttaattctaaaactttgtcatgcaaatcttgaatgaatggaaccacagagagacgggacggacatagttttcaacaatgagaacaatattagattccctgagggagtgtttcagtccttggtggaagccaagatacatgtctaggagaaaacagttctacagaggccaagataatgtggtactaaaatccctggtgggctagttcaaggctatctaatatggtagatgagctgagtgtgcttcacccagtcttcctagttctactactctcaacgagttcgtaatacttcaggatagatcacagatgctgggaaaccgttcagcaaagccatggtgcaagaggaaccattaatagatcaacgtctggcccaggagcagatctaccaggacctatgagagttttcttttcttttcctttcttcttttcttttttttttttttttttttttttttgagaccaagtctcacattgtcacacgggctggagtgcaacggcacgatctcggctcactgcaacctccgcctccaggttcaagcgattcttttgcctcagcctcccgagtagctgagattacaggcacacgccaccacgcctggctaatttttgtatttttagtagagatggggtttcaccatattggccaggctggtgtcgagctcctgacctcgtgatctgcccgcctcagcctcccgaagtgctgggattaaaggcatgagccaccgtgcccggccctatgagagatttctacccagggacaagaatggaagactggaggcctgagatattggaacaaattctaccttctctcttttattttcataaataagccccttttccctcatgttccctagcttgaggggcttgatttaaagagccactcgagcgaacccaagagcatagaaacaggttataaattatcaaggtatcctagaaatcatttggttgtatggagtgaaggataacatgagttgtagctgcttaaagagcaatgacagagttgactccctttggcattggcggaaaaaaagagaacgagaacagggagaattcgttcaagccctggaacttgcttatttgaagcaaccctccataatcctctgacactgaaaatccaaccagagacaccaagttggaatattgaactattttccaaaaacgtggtatcactcagtgggaaggttccttgttcctataaaagttccccccaaaaagatccgccctctggaaaagtccttaggaatataccaaatcctaaggcagttacaagggaggagtctttgttgatataattaatgctggccatccaggaagcagtatgcaaattatgactgcactgaatggacagaacctggaaaccaggacaaaatgccaaccaatgcctgtgcaataggttttaatcctcccattcctattttcactgttcatctgggactaaaaatgtcttcaccctcccactcaataagctgggagggaaggtttcaccatgaactagctgatacttgagctacagaaagtcagcctgtgcgagcaaagatcgggctgaacagaagctaattcctgccccaattcctagagttttgttcaaacctattgtattatggtcaacatccggaatgaacaactaataattgcagcaatgccttcagggatttttgcctgtttacatataaatagttctgaccagagctggccaccagcaatggttaatttaatttactatcccttggcaaaagaatagtcattggatttccagcacttttaaccttggtagacccttgggaaataaaaattagattgagagaaaattaccagtggtggagaacagtataaaagtgacaatgacatatataaacctccggcaggagtggaataaagtggcatattattgttcgctggctcccaaagttcaatatttcttgtgtgatttacacttctgccattgtctcaccccctggagtcattctggccactcggaagtctctcccaaaatgcacacccttgttactgtcagagaaggggcatattacctggctaagcagcaagaggtgtttagacaaagagccattagaaaatgggtttcaacaaataagagtttaaagaggtgtctggaaatatgagactgaaaatatatgggaaagaaaagtcgataatccctgccttcgcagtcgtgtgtgtgtgtgtgtgtgtgtgtgtgtttgtgtgtttaaagaggtgtctggaatgagaagcagatgagtgtcttgggtgttccaggctactggttgcacttcctctatagaattatgtcaacataatctgtgtgcaaactcagctctgattggagggtcatgatgctatctcagcctcactgaccatcagttggtgctcccactacatgaaccacctgtggtacacacacacacacacactccccacacacaattgtttctttttcctaaacctttgctcatgtggtgttatctgcccggaccacccttcctcccacctctgttttgcctgtctggctcctaacttgcccttgaatacctagcccagatatctcttcctctaggaaacttttcctgatcacctcctggccagatgtgtactttctttagtatcagcctcctgaatttgtcactcttattatttgcatcaatctacttatgtgttttttttttcttttcttttgagacagaatctcactctgttggccaggctggagtgtaatggtatgatcttggctcactgcaacctccacctcccaggttcaagtgactctcctgcctcagcctcccgagtagctgagaatacaggcgcctgccaccatgcctggctaatttttgtgtttttagtagagatggggtttcaccatgttggccagcctggtctcgaactcctgacctcaggtgatccatcctcctcggcctcccaaagtgctgggttacaggcatgagccactgtgtccgaccctacttatgtgtctttctatcccaccttcagaatatgtaatgagactactgtgaccttccaaaagaaaaaaaacaaaaacaaaaaacagaacatttaagcctggagagagaggtcagagtataaaacaaagaacagaggcaagaaagttaggaaactcctaagtaacatatccaactagataggattcctggtacaggcttttcttttattgcacataccacagttgtatttttattatatttgtgtgatcatctaattaatggacacacacacaactgtaaaggaagagattgtgtctcccttcttttctatatcttcagtacctagcacatagatggtaccttatagatatttatgtaattaattagtttataaattaataagcagacatataatggataagagagaaaaaagtagacataagctcataaatggggctaaattccaaagttcatttgtatgtgtctccatggcacaaggatagacaggaacgccacatagaaataatggatattgagttctacttctgataaacttatatccaagcctgggaaggtctgattctaagacttacctttaaacaaatattgaaactggcatgggatttctcttgcccaatagaacccaaagcccataatttactgaggataaacagacttacatgataaagctgtccagaatccaccaacaccttcattttacatgtaatgaggtggagcaagatggtcctcactccccagatggtgtaataacatcattagagagaggattgcatttgtttcggagacaccttgacttactgtttgggatagaacacaagaccccgaaagtcatgtgccagtcaccaaagtgccttgaataaaggcgatcacagtgaaccttgggttgttttcttcaccaagcactatcatgaacagaatttgtaagtttgaagtgaggaagaattgttctgataatagagaagagaggagccagggcattcctttgggtgttgggggagaaagacacaggagtgaagtaacaataagagacatgaggatttttccagttgctcgatctgggcaatgtgatataaactcgcttttatgtctcctctacattgtctttagtaaattaacgcttaactcattaaatgctcttctgtgagtgggtctttatgtgcagcaggggtaagaggggcctcaaagagaaggacaagtgaacagctgacagctaggtgtcaaaggaatgggggcaggattcctagctgagctcatttgctaaggaacccttggctagtcatagactgagccatttcaaatccatcagtttcatctctctctctctctcctatacattaaagatttcaattagccagttagcagggtactgcagggaaaagggaaggaagggtgagtttattctgatgagttgttttcaacatttactgacatctaatacatgtcaaacaatttacatggattatctcatttaaatttcacagcatgtctatgaggtggttggtgttatttttattatgtagatgaagaatggaaactcaggctcaaggaggtaaattgtcccaagttgtagagccagtaaattttagagtctggatttgaatccccatctatctttacaccatattatgctatctcttaaaaaagggctgggtggttgctaaggaagatggagggaaacatatttacactgatgtggggtggcggtgggaaatgatgccaccaaaattcaggaggattttcctgaaggtaactgttgttgccataaagtactttaatcctctagtcaaccaaaaaggtgccactggtgagatggataaccacggacttgtgaattgcaggacttaattttggcataattaccaaaggaagtcagacagtattgcgggaatgtaggctttggaatcaggcaaatcctcatttgaatcatggttctgatttattatctaaaacagttcaactctaaatttccctttagaaataataatcataaacataaatttaacaattagtcaaaagaagagctgctcttctgaatcagggaacaaccgtcattagagaataataactctaaatctttttcactgaattcacagcagccctcagttaacagaccataagagcttaatcttgcaattttcttaattcctagaaataaactgaaacctctggtgcctgtgggatgaatcttaattttgtggaggagactctgttgatattggtgactgttttgtgaccttgagcaaatgacttcacgtctctgagcctctggtctgtcatctgtaaaatggggataatcacatatgacagttaattttgtagatgatgtgagataatgcatgtaaagtcctgagcacagtgcctggcacaaagcaagcactcagtaagagggagtgatgaggattgggatgatgatggcaatgacaaaaacaatgatgcaacaataagaccaagataagacaatatgttgatgttgatgtggcagtgatggtggtaatagtggatgatgatgatgatgatgatgatgatgacaaagacaacagtgcaatgataagaccatgaggagcaatgagcaatcatcatgatatactgtttgttgctgctgctgatgttctgtttgttgctgctgctgatgttgtagtggtaaacaatacagagaagaagaaacaagaaggaaggaggaagggaaacataaaaaaaggatttgatatggtttgactctgtgtcccaacccaaatcttaccttgaattgtaataatctccacatgtcatgggagggacccggtgggaggtggtcgaatcatgggggtgggtctttcccatgctattctcatgatagtgaataagtctcatgagatctgatggttttataaagggcagttcccctgcacacactgtcttgcctgccgccatataagacatccctttgctcttccttcatcttctaccatgatgtgaggcctccccagccatgtggaactgtgagtccattaaacctctttcctttataaattacccagcctcaggtatgtctttcttagcagcgtcagaacagactaatacaggattaaaagaagaaagaagaggatctccataaaacatcaagtgcaactcataggtaactgggtttcacatgcccaaacctaaggtgttctgattctccaaccagaacagatatccttttcctgattagaggtgcaatgccaaccacatcaatagacatggtctctgggatccctctaaccccattcaccacctggttctctcttcccatcaaggatgaaaaagggattttttttttattctctgtgtgcggaggataatgcatctgtaaactcatcataaccccatagccagatgcttctgtgcagtggagccagcaccatcaaggctaacaaaacacagcatcaatcctcaagatcctagtttctgggtggactgagaccatgcctgggaggagctggccaaaccacttcctcagtgttatcatttatgaaaccaaaatgaagcgttttcaataattataaggacatgaagtagatgactaagatcatacaagcaaatgtgctccgagttcgttctttcaagtagtgaccatgaatatcttaattttttattatgatgaaatgtagaattatcctcatgattaaaagcatgacttttaatgagtcatttaatctctctgcatgtctccttgatgaaataataactttatgtagtagtaccaaccttataagttagaagcgagccttaactaagataatttacagagtttaacatactatctttcctatagtgtctttcagaaatattagctgataatattattactattatgtaggagacaaaaagaaaattttaaaatatacccaaaatacatatctgattatgtgaaccccctgcttcaaactcccagtgatttcctcccagtgctaaggatggaatccaaatgccttaacatagctagcaaagctctttatgacctggcttctgcttaactctcactacagagtaaaccctcctaaactgctctcacacctttcaggtttcaagtcacttccgtgtttgcactcttccatccaactgttggcccgcctagcacactcagccctcaggctgggggaactgccttcctccccgagcccacagccctttgagcctcccccatcacagtgtagttgaatgatttcctggtggtttatctgttacctcaactacttgggactgagatggtatattaatggttcttcctcgccgtctagcatagtacctggcacagagcaaagcccaataaatgtttgctgaatgaagggaggagtagtgtgattgatgttagcatgggacacagagaaggggtgtggcaggggaatcagagggagattgatggaggatgacacctgagcaggatctttaggaacaggcaagatttacccaggcaggtttttttttaaagcaatggcaatacagaaagagagaacagcatgggcaaagcacagaggtctaaccaagcatggcacctttggggcaacttcatatattcacgcagcactgcaatattccagagtaaggaaataagagataatgtttggctatgtgtgccaacaagataccttgtctttatcctgtaaagattaagcaatcattgaagaatttaaagtagagcactgatcagatcaggcagaagcatgagattaatgatcctgttaacactctttgatattttcctcttctttcttcccaccctcccatccttttctctcctttcttctatcttcttcctctgtcttctaaaatatatcctttcattttctacagtttgcctttacatggattttgttgaccccagatgttagaggaccatgaattaagccaggcaggactcccagcatcagtcaggattcaaggggataaaatttcattctgatgacccggagcactaatgaacacttctccccaacacgagtcctctaaaaatggtctgaaatgaggcagaaatagtacgttatcttgatataaagggaacacgttcatcacttgcttaaactaattatttgtctgagagtgacggtggcaacactgaccttttccaatgatcaaaacacttatttttaaatggaagatgtaactcttctcatccctcctctttgttgaaatgtctgacctaacctcattcagtgacgaatacccagaaaagcctgcttaacagtgtgattagtgaagttattctaagatagtgatgaccaaactcaaagtcctagactattttaagtgttcgagttagggtttaggattagagtttagcgttcagggttagggtcatggttaatgttaaggttacgtttgatagattcgattaggatgaaagttagagttaagaataaagataagggtagggctagattagagttaaggttagggataagatcagggaaacttctggagaaaagagaatgagattagagggcagctaagattccagccactcatatgtacacactccaccccaaactcattgtttccctatttcttttctgtttagtttcacttgaaataataataaaaggaatctactcttctctgattcatagacagggtttgaaactcacagaactagagaaactcccaagccatgtgtgagagtcaatgactgacaccacagtccatttttcaggaactcagtagtctcatgaataaaaagtatttagacttctgcagatgacaccccacttaccaagctaaagctgtctcagatttggcagaagctgccccatgacacagggtttgaggcagggatatggatcatccacttgcagaccccttgggcaagtggatgctctgtataactttccttcttgactggcaggatccagggaatatgaccaaaaatgggaacagggccatgcttaccatcttttgcagtaaatggaaataaggaaaatatttaagaatggctatagtcttagccaggtagaaaggccaaagaacaggattctggatctgagaggttaggcaaaaaccatttcatgaagccaagaatgtgggttgggaggagaattgatcaggcatggtaagtgaacctggagaaatttttgagactatggacctttataatagagcttggttcagcaaaacggttctgtaaagggccagatagcaatgctattttaggctttgtaggctatattcagcctctgtaataactactcacctcttgctctagaacaaaagcagtcatagatgagacatatatgaatgactgtggctgtgttccaataaaactttatttaggaaaatagatagcaagccagatttggcctgtggaccatggtttgttgacccttgtactagggtatttggagagcttgttttgtgaacccccaaagagaacagtctcctaagaattaaaccaatatagaaatcttgcagaatgaggacattagaaagcaagaccaaggctatagcattattagaaaccctgaatccagccatacctgaaactaactttctctggtatcctcatttacgtgaaacaataaatcctctccttttattgttattgtttaagtagtgtgagttaggtttctgtccattgcaacaaaaaaagtccttcttggtatacaatacacacaggctaacagaaaaaaataatcaggtctcattacaaatcttctgattcccattccagtgctctttcatctcaacaagcagcagatagaaaagaatgccctagttgagatatcttttgtagccaaacatcagtgttgccaatgtgaacctagagtttgctccaaaacattcctgcttgttggagtgtcattaagggaaagcgtgtgcctaggaaatgctgcccgcggatgaagaaagttgacagaacagccctgaagggccagatggattccagacagctgtgacttgatggaggccctccatttggcaagaccagggagagcccagcatgaacgacatcaattagcaacctcttttgagagaggatgattacagcacaccactgcaatcaagcttcatgcagccactacatgtaacggttattgagcctctgtagaaacacacagacatgtgtggtatgatttttaaaagagaatagcagaatgcactgggattctcatacattcctgaagagattgtgaactggtgcaaactctctagaaagcaatttgacaataggtatcaaacacctttaaaataaaaaatctcaagacatttgatgcagtcgtcatccttcacccctgtaagaattgatcctgagcacatatcagaaatgcaaacaaagatttctgcacaaagatgttcatcacagcattaagtataatagcaataaaagaaagcgtacaaatgtcaaagttaggaaattaatgaaaaatattatgatacatagccataagatagaaaattatggcagccatcaagagtatgattaagaagagtctttaatcacatgagaaaatatccacactatggtaggcgacaaggcagcatacaaattgcatatataatatgatcaccagtaaatcaatatatggcatgagtttttatttttatttacccgggtacagtgatgacatgtttgagttgaaggactcagggctccttttatgggcttatttgcatggggatgtttggggctacagaagagtcaaggaggtaggagggttcctagagggaggagaaaacaaggactattaaaggtatgtaataatgtgatgatgtctgatccctcactatgatacttttgaggttcccattgagaagttctaggcagaatttgaaagacattaaatgtcactcttcaacgaagcctttccattcccccagtgacgaggtcacatgcccctgatctatgctctcaaagctttttgtgtttctccttccaagcacataagagatattatcattgtctatttagatgatatgtgattctcactcagttctgcattgttgaatatggtagccactatacagagcatgtggctatttctatttaaatttaagtcaaataaagcaaaacttaaaaatgcatttctcgctcacactggccacatttccagcacacaatagccacacgtggcaagtggccatcatcatggacaagacagatacaaaacgtgttcctcagggcagttttattgaacagtgctgtccaagactacaatgttatgaggtctcgctcacatgctattcctagttcctagcacaaatatctggcatattacaggcattcaataaaaatatatgctgaaggggccggctgtggtggctcatgcctgtaatcccagcactttgggaggccgaggcaggtggatcatttgaggtaaggagtttgagaccagcttggccagcatagtgaaactttgtttctactaaaaatacaaaaattagctgggcgtggtggtgtgagccactaattccagctactcaggaggctgaagcaggagaatcacttgaacctgggaggcggaggttgcagtgagctgagattgcaccactgcaatccagcctgggtgacaaagtaagactccatctcaaaaaagaaaaaaaatatatgtaaatatataaggaatattaataatattaatatatattaatgaaacattaatattaatatatattaataaaatatatcaatattaacatatactaataacatatattgataaaacatatatttatacaaatatatatttaatatatatttatacatatatatatatttaatatatatttatacaaatatatatatttaatatatattccttccttcagcatatctgtggagatgactttataaaaaaggaggtcctcagtacaggaagaggaaacacacacacacacacccctcagatatgttcctttttcaaataaccagcaccattaagatctcatgaacgtatttggtagggaataaacacaataaataatgatgatagaattctgagctctgagtaggcattcaaacaggcaggatggatcctgaccgtgagggtgtctgtgatgacataaatcatagcagatccaacatctcaggaccacatctgacctggaagcagcatgaccctgtcacagggactggagcacttggcaagacagagctcactgaggagctgatggtggccagcctagtctctcatcaatgacatttttttttccctgacagctaaaagacaaaaggtttgcattcgtggccgtgtacgtggacatgagggttctgaaccttagggctctcgaaggcccatcccattcaacgtctctctgtctcctctgcccaaagaaaaagccaataattcaaaaacctcaatgtggagctgcatgaaattgttctgtaacacactttcttacctacaggaggggctcagataaatgttgaatcaacagataagtctgcagccataataaggaatgagatcaggtccttcacagggacatggatggagctggaggccattatcctcagcaagctaacgcaggaacaggaaactaaacactgcatgttctcgcttataagtgggagttgaacaatgagaacacatggacacaggaaggggaacaacacacactggggcctgctgggggttaaggtggggggagggagaggattaggaatgctgggcttaatacccaggtgataggttgatgggtgcagcacaccaccatggcacatgtttacctatgtaacaaacctgcacatgtaccccgaaacttaaaagtaaaaatttaatttaaaaaaggaaattacaaaaaaaaaacaaaaacaaaaacaggtaagtctttgtcttggttggatggtagttggtaagaaacagtcgcatattcattcaacaaatgtttattgggcactaactgggtgttaggaattattttaggcatttggaatagacctgtgaacaaaacagaaatcaacaaaaatgtctgccttcatgaaacttacacgccaggctggttttcagccccggctggatattagaatcatcagggaagttctgaaaaatctcatttcttgggacacagctcagagaaattctgaaactctatagttcaagatggggaatagggatatgttgttaggaagtttcccaggagagtcagggtacagtagcctgggagcctgggaaccactgttgtaaaacaatggttctcaaagtgtggtccctggaccagcagtagtggcatcacctgaaaacttgtagaaatgcaaattctcagctgggcacggtggctcaagcctgtaatcccagcactttgagagactgaggcgggtggatcacgaggtcaggagatcgagaccatcctggctgacacgatgaaaccccgtctctactaaaaatacaaaaacaaaaaaaaaaattagccgtgcgtggtggcgggcgcctgtagtcccagctactcggaaggctgaggcaggagaatggcgtgaacccacgaggcggaacttgcagtgagcagagatcgcgccactgcactccagtctgggcgacagagcgagactccatctcaaaaagaaagaaagaaagaaagaaatgcaaattcacaggcctctccccagatgtatagaatcagaaaccccgtgagtgggacccagcaagctgtgttttcacaagatctctatgggattttatgtgcttaaatttgagaaccattgctctaagcaaaattacctagggagatgagttttatgagacagaggaatcctcctctgcatcttttcccaatgtgcttctgccaagtcactaaacctggagaggcatcccaagagcagcctccccaggttggtacctgacagccacactgggttttcagcagctctctccagccactcaggacgctgccccacttacctaggctcctctccccactcagttccccgattagcataatccttcccagctgctgaggcctgcagactagacatcctccagttgacctccccatcataaactgagatatgatggtcccccacagctatctgaggtcttggtctcccatagggctgcacagaaagggtgcacattcatccaccaaggcatgacccgctgcggcacacacacacccagaacctcattttacacaacacacacaaacacatccctactctatcacacatgtaatgtcacaaacacacaatcacatattcagttacacgtacattcacatcctcttactctgttctacacagagacacacacatacatgcacacacaatatcacgggaccagtgattctcaaatgtatctaaacattggccttacctgggagctttaaaaaattctgatgctcaggccacagctcacaccagttaagtcagtatctctggagctgaaagccaggtacatatctggctttaaatctatccaatgtatatatttatcacagtttctttatccacttactgactgatgaccatttgggctacttccacatttttgcaattgtgaattgtgctgctataaacatgtctgtacaagtatcttttttgtattatgacttcttgtcctctgggtaggtacccagtagtgggattgctggatcaaatggtagttttattttcagttcttcaaggaatattcacaatgttttccatagtggttgtactagtttacattccaactagcagagtagaagtgttcccttttcacttcatccatgccaacatctattatttttttattttcttgattatggccattcttgcaggaataaggtggtatcacattgtggttttgatttgcatttccccgatcattagtgatgttgaacattttttcatatgtttgtgcccatttgtatatcttctattgagaactgtgtattcatgtccttagcccactttttgatgggattatttgtttttccttgctaatttgagttcattgtacatatggtggaatactactcagccataaaaatgaatgaattaatggtattcacagcaacctggatgggactggagataattattctaagtgaagtaactcaggaatggaaaaccaaacatcatatgttctcactcataagtgggagctaagctatgaggatgcaaaggcgcaagaatgatacaatggactttggggactcagagggaaagcggggagggagtaagggataagatactacaaagtgggttcagtgagtactgctcggatggtgggtgcaccgagatctcacaaatcaccactgaagaacttacttatgtaaccaaataccgcctgcttcccaaaagcctatggaaataaaaacttaaaaaaaaaaaaaaaaaaaaaaaaactcagggaactgtaaaaaaaaaaataaacaaaataaaattctaccaaaaaaaataacgtacccaagtgattctaatgtgcaaccaaggttgaaatctactactctacaccatggccttatggctaacagaaaaaagaaataagagggtgtcaatttcctttcacaatggaaggggcaagagaaatggagaaaactgaatttaaacgacttccaaacatctctggtggaatccccggagtcataaatatccagaccacttgtctggtgtttctcgtacacgtcccaccatgtctttttccatttgtggatgtccattagtcaacgaccactaggaacacactttcatcaaacaaagttgggtttattgatccaatgcattggaggaaatggtgcaccgtggagaaccatgaggcatcagtgtaagagactgagcagagcttcttgcaggatttgggcttgtgccgtacactgtggaggaggtttcaaggaagcagggattggatatgtcaggaagggaggccagttccatgactagggcttatctaggggtcaagaggaatgaagttgacctaaaactctactttatttattattattattattattattattgttattattgataaagaagcaggcataaggcaggaaataaagatattttatgattcttatgctttggacaatgttcttgcttttgtttgtgctcagacacaattatgggccagtcttgtgtttgtctttctccatcattagctgcagagtggtccttatctgacgtttatcatttgtgaaattgttcctgttcaggaggacagcgggagagactagctggacatgccaggccagctcccgcctgtcagcagctgcctttttctttcccctatctcatcctctgttctccacattaactctgtgttgtttctttgcttctaaaatgtgtctgcttcttccacaaggtgatgaagttcatcttttcaacgtcctttataacacatggcacagtgctaggcacatcggcgagggaactctaacattctgaaaagaacatgaggttttgatttggaatcagaagacccgctttcaattcctgctttctacttgctaagtatgcaatttgggcaagtggctcaatttctctgagccccagatggggatgataatccctgtctagttcactggatttccaggaaaaggaaaatgagacaactctgcaaccacaaggagttgacaaagcagcagattctcgagaaatgtgcaaagggtaagtcaatgaagagaagaggtgattggtttgaccaatacctttatcaagagttgcaaaggacaatggcttaagagacctctaaagatgccatagtggatacaggaagtcgaaaaacaggtggagttctagtcacccaggtgatccttcagctcttagaaatggccttcaagataagcaactagaggttgaatttgtttagaatgccgcactccagcagtttctgcacgcctactatgtgccaggcattgtgatacagatgtagaaaaaaaaattagagttttttttttttccccaaagatgcttctagtcttttgggagaaagaaaggtttcaacttgacataataaacaatagaggcacttacaaagtacagcacagcatagagcaaacaggagttaattttgtcagtggctgggcagaagaagagccactggagatggtagggaaaaaccaaagaaaaaggagaatgcttcagctgggatttggggttttgtttgtttgtttgtttgtttgtttgaagtgaagtctggctctgttgcccaggctggagtgcagtggtgtgatctcggttcactgcaaccgctgcctcccaggttcaagcaattcttctgcctcagcctcctgagtagctgagactataggtacacaccaccacgtccggctaatttttgtatttttagtagagacggggtttcaccatgttggccaggctggtctcgaactcctgacctcaagtgatctgcctgcctcagcctcccaaagtgctgggagtgcaggtgtgagccaccgcacctggccaagctgggcttttgaaggatggataagaggtttccaggcagatagatgaggaaatgtgaaggggaatattccagcagaagtgtgaggggcagtgggttcaaaggtacaacagtatgaactactctgatgtaacccgagatcttgaaacccatttataaataagcggtgatatgagtgggtatgagacagtcatatccaccccagctcataacaacattgtttagggcacagccctgggctcttcccttggcatttgtctttttagcagacattcagaagctaatttaggggcagctgtcaagagctttgagcttcacagaccatgtgagtgaacttcctctgggtaaccaaaacggagagaaatctggccaaatgtactggccagagagaacttccttaaaggatccttttaaaatacactacatacaattcagaggagcgggtacctcctgggtaccttccactggggtggatattctttccagctcccccttgctgaattcacaccatagccaactggctaatgagccacttgagccacgtccacatgtcagctgtcccagaagcagttaaccttgaaacaattgtgccccgcccccgccacaaaggcaagcatacagtaatgctcacttctagaatccctcttctgggtgaccgagggcctgatgaagacacaggtgccacaacacatataaagaggccatcttcattggtccaggctactacaacaaattatcatagactgggtggctttaacaccagaaattcctttttcacagctctggaggctagaagtctgagactagggtgttaggatgatcagattctggtgagagctctcttccaggttatcgacagctgactacgtgtcctatccccacttggcagaaagaggatgggagagtgctgtaggtcccttaaaaaagggcactaatcccattcatgatgctccaccctcacaacctcattaattagttcccaaaggctccacatcctaataccgtcatattgggggttagaatttaaaaatgtaaactttaggccggccacagtggctcatacctgtaatcccagcactttgttggggctgaggcaggcagaatacttgaggttaggagtttgagaccagcctggccaatatggtgaaaccttatctctagaaaaatacaaaatttagccgggcacagtggtgtgtacctgtaatcccagctactcgggaggctgaggcaggaggatcccttgaacctgggaggtggaggttgcagtgagccgagatcatgccactgcactccagtctgggcaacagagggagaccctgtctcaaacaaacaaacaaacaaacaatgtacataaatataaattttgagtagacacaaacatttaattcaatacaaagtccaatatacacataattaaaattggtatatgaacaaataaatttaactagaccttgactttctcatctgcatctctagaagtttacatattcaacttgggtttttagaaaagcatttaaccatctcactaaaaaaatgagagttatcagtttcagaagaatttaatattgagtgctgtgagagaagatcagagaaaatcctgattaggagtaggaagctgtgttgaggaagtcaggtcttcaagtcactgtgccatcctcaggcaccacctacaaggggcactcagcactctcagagctgttctgattcctagtctgaacttcccctcccaaaggctccacatcctaataccatcacattgggggttagaatttaaaaacgtaaattttaggccagccatggtggcttatacctgtaatctcagcactttggggggctgatatatctttcatatagctttccatttttcccacgctgcctttgacactcctaggtatcaacctcgctctgtgctctcctattatcctaccctcttccctctataaaccttaggcttaaaactacttccctgactcgatccctactgatatttttctctttttacattttacatcagcatcctggaggtataatttctagataataaaatgtatccatcttaaaagcacagcttgatgagtttcaacaaatggttattcacataaccagcatcccaatcaaaatacaaaacccaaatcggtgccctcattctcctctgtagtcagccctttctgtgactatagattaatgttcctgttctagaattcattaagaatggaatcatacagcgtgtgctcttttgtgttttgtgtctgactgctcttattcagcgtgatgtctctaaaattcatccacattgttgtacatgccagtcgtttattcttttttttttttttttttttttctggcggagtcttgctctgtcacccaggctagagtgcagtggtgcgatctcagctcactgcaacctccgcctcccaggttcaagtgattctcctgcctcagcctcctgagtagctgggattacagtcgcccgccaccatgcctggctaatttttgtatttttagtagagaccgggtttcaccatgttggccaggctggtcttgaactcctgacctcagcctcgatccacccgcctcagcctcccaaagtgctgggattacaggtgtgagccactgcacccagccctcgtttattctttttgtggctgaaaagtatttatttgtatgaatatacacattcatgtatccatccacatattgaaagatatttgggtttttccagtttttgagtagtacaaatgaagtagctataaacattcaaagtcctgcactgcctttgttctatgtgcgaaaaatagttctttcatatatattgtccagttgtctaacgtctcatggtgggcaagataatctttagttattatcaacaaattggcctccctgccgcacccagacctgctgtcctcatcctattccaggatgcgctgtttggctcaaccctaagaccctcctctcccagagaagcatttctaccaggcgtgccgctgccctaaaaatagaaaacagatatttaaaaatcagactttggtaatcaggttaacatcaaccaatgaaaagtcatggtgacggcatgcattccctgacacgatgtcacaagaagggcacttttctccatagtattcttcaccaagactgcaacaccaggttgattaatcatgagaaacccaaattgacaggtaacataacacctggccagtactcttgaaacctgtcaaggtcaagaaaaaacaggaacgactgagaaactgtcacagaccaaaggacaggaaggagacatgaccacgaagtataaagcaatatcctaaatggggtcttagaccaacaacaacaaaaaatgacattaatggaaaaactggtaaatccgcataaagtccagagtttggtggagagtaatgtaccagtgttggtttcttggttttgacaaatgtacattccatgttgatataagaggttacaaaagaggaaactaggtaagggaactgtctgtactatttttgcaacttttctgcaaacataaaattattccaaaataaaaaattaatttaaaaaatgtcaagctgtaacagtctcagcccatgatggccaataaagcaataaccctgagctgtggccgttgagtctaagcctgctctgctgcccctacacctgcattttctgagaaaggtgaatgacccctcatctgtttgcacttccggtttattttttctttgctctttgtccagatcttcttgggatttgtgattgttacatcactgcattgttaatacagccagaaatccttcccgtggcctttcccacaggttgggtgataaactgccccaacccaaggagggagagacgctcctttgaacaaagcagagacgtgttcacattcaattccagctagctccaggaagaggaagagaaagctgtgggggcacataccctccaaagttctttgggtagcattatggcctctaataccctggcttttccatcattttccctttttcactggaaagcaaagcaccccagagtgggtaaggctgccattttacaaaccctgcgccctgctctgtagttttatttcccaaggttaacgatccaaataaatcggccctgtcttgcctctgctaagctgcttgagaaatgttttatagtcaacatagatcagattggtaccttattcctttgaaagttgtcctcggtagaagttctcgctctacctaatgaaccaatattagtttaactacatgttattaattaaaagtggaattttatgcagaatctttttcccctactaaagaagaaaaaggaatattgtacttcacagattcttaacagaatagtagtctctggatttatgggcctcttttaatggacatcatgaaatatcttttaaggctatcctacccttagggacttcattcttcttccacacaagatctggtcacaggtaactctctatagcccaggtcatttagctttcatgtgtgggagaagacctttcatcttaggttctcaaccttttcttcatcccaaaccttttcctggtaagtcaacatgaattgtgtgcacaagaaaacaaatgccatgtctcctggccattctggccacagatttaggggaatgtctttatttgggttattccagaagtaaaccctgaaataaggattcaagttgcaagtaccttattaggaagtgctccaagaccacatgagcagggagaagtaagacagggaagcgatggaaattcatataaagggggtgttatcaggtaattcatacaaacgggttatgtatgaataagttatcatataaagggggtagttattagtatgggtaactggggcttatctacactggcatactctggatccaatacagaatgcacacctcggagtcatccaccagggagactgggagctgggtcttcattcctcatctttcaattgtcacaggttggcagctactcctggggggtgttaatttcccaaccctcctggcctccccttctagcctctgtccatgggcagagtggactccaatgatcaaagagagccttcaagcaaagagacacaggcgctggcagttgcaaattaggccaacttccagggaaactgtgagagctgataggagatggctggccaccagaagtacatgcaaatcagtgcaccaaggcagagatggggatgcagcccagccctccagccctctggccatgttggataaatcacgcttctgcctttagcatcaagagaacacctggcatgatttcagacaagatcgggcacgttcagggttgtatggccatagacacctggcatgatttcaaaagtgtgatgggttagtccagctccaggaacctgctggctggaagtcagcatgctgcctctctttgtgtggtcctaggtagtgacacagtagaaagatgatgagccagtaggactggttctgccactagtggttaccttaggaaagtcacttgacctctctgaaactcagtttcttctatctgtgattgattgattgacagatagatagatcgatgagactatctaagatgtgatctcattagtacttaccctgaatgaaagctaatatatctcatctataattaagaaagctagggtgtcctgtgttgctgagtcaaatgagataatgtactcatcaggctctgttatgaactaaatgtttgtgtttccccaaaatttgtaggttgaaattctaatcttccatgtgatggtatttggaggtggggcctttagcatgtagttttacatgaggtcatgagggtggtgctctcataatgggattagcgtccttctaagaagaggaagagacagaataactctctccaagaacacaaaccacagaaaggccatgtgaggacacagcaagaaggaaactgtctagaagccaggaagaggaccctcagaatgagggtctgcagaatgaatctgcagacgacttgatcttggacttctcagctaccagaatcatgaaaaatacaatctgttgtttaagccactcagtctctggtattttgttacagcagttctagctgacaaagacagcatcctacaaaagataaggtagtgttgataagaactccataaggatggcaaaaatacagcccaaagtaacccagggtatcctgggttactaaagatattgtaaccaatgtatgaaaatggatatgagatttcaggggttgtaagaaacataaatatcaaatggaactcatgatctttgtttggatcctggctttaaaaaaacaattataaatatatatttgaaacaaatggagaaatttgaacatggagcaacatattagatgatattaaggaatttgtatttattttgttaggtgcaatatggtatatggtactatggttttgtaggaaagtgatctcttttttttttttttaatgcagtcttgctctgtcacccaggctggagtgcagtggtgtgatcttggctcactgcaacctccacctcccaggtttaagtgattctcctgcctcaggctcctgtgtagctgggactacaggtgcccaccaccacgcctggctaatttttgtatttttagtagagacggggtttcgccatgttggccaagctggtctgaaactcctgacctcaggtgatccgcctgcctcagcctcccaaagttccgggattacaggcgtgggccaacacacccagccaatctcattattttggagatgcaagttcatatacgtagaggggaaatgttatgatgtctgcatttaatgtaaaataattgagtaaaatctggcaaaatgctaacaaatgctatgtggtagctatattcattatactgttttctctactttttatatgtttgaaaagttccataataaaaattttataatgttttaaaggaacttttaaaatatatttttcaaatatcaaaaaaagtagacagcacaattgggatttatttatgttgctgtattgaaccctagttcatttattttttattgaaaattttattgggataattatagattcacatgtagttgtgagaaataatagagtttccatgtatactttacccagtggtaacattttgcaaaactagggtataatatcataaccaggatattgacattgattgaatctaatcttcttccaaattcccttgttttacttgtactcattggtatctatgtgcatagtgaactgtatacaattttatcatgcatgtaaatgcgtgtcacgatactgaaaagttccatcactccaaggatccctcatgttgtccttttaaaaccacgcccatctccccttcttcaccgcccccatctctaaagtctggctcccctacttttaaaatttttgtcatttcaaaaatgttctataaatggaatcatatagcatggagcctttagtgatcagcttttcttagttggcataattccccggatatttatttgagttattgcatgcatcaaaagtgtagccctttctcttgttgagtcctgttccatgaaatctccctatcacggtttgctaaaccattcacctgttgaaggatgtctgggctgactccagtttgggggctattacaaataaagctgttataaatatttgtatacaggtttgagcatacattttcatttctctggcagaaatgttcaggagtataattgctgggtcatatgctaactgtatgattcattttatttttaaaaactgccaaactgttttccaaagtggctgtatcattttacattccccaccagcactgtgccagggatccaggtttcccacaaccctgtcagcatttgctgttgtgactactttttattttagccttctgatagatgtgtagtgatttctcattgtcttaatttgccttcccctgatggctaaagatcctgagcatcttttcctgtccttatctgccatctgtatatcctgctctgtgaaatgcctgttcaggctttcccatttcctaattggactatgtttgttttgtttttactgttgaatcttgggagttccttgtatatttagatcctaacaccttgtcagatatgtggtttgtaaatattatttcccagtctatcatgtgtcttcacatgagctttctcagagcaaaagtttttagttttgatgagatccaatttaagctcatggattgttcactgttctatagtaatccactgtggctataccacaatgtgtgggccagaccaagtgacttcctgctaacaaatagaatatcactaaagtgatgagataattgaggttaggctgttaaaaaaaaaaaaaactgtgacatctgtcttgcttaccctctctcactctctcgctggttcactctaagagaacacagctgccaagttgtgagctgctcaatggagaatcccaggtggtaaggaactgatgtctccagccaatagccagagaggatctgaggctgccaataaccaggtgaatgggcttggaagtggatcctacccagtcaagccttgagatgatggctgtagcccagccaccaccgtgatcacagcctgtgagaaggactgaaccaggggtacccagccagttcccatcccaaagaaacagtaagaaaataaattgtctaattttaagcttctaagtgttggcataatttgctatgcagctaatacacacaatatgtcttatttatggccatttaagatgtttccattttttattattataaacagtgaagcaatgcggattcttgtagagatgtacttaagcacatatggaatagtttcttggggtgtatgcctggtagtgaaatttatttattcactatggaatatcaaatgcaaaattttactagattttaccaaactgttgtctacagtagttgaaacattcccaacaaaaggtatccccatttcgccacattctactcaacttttggtactgccatattgatgggtgtggaatggcatcatatttctcaaaaaaatttttgagatagggtcttgctctgttgtccaggcaggagtgcagtggcacaatcattgctcactgcagcctcaaaacttcgagactcaagtgatcctcccacctcatcctctcaagcacctgggtggaaaggtgcacagcaccatgcctggctaattttgttcgttttttttagggagacagggttttgctatgttgcctaggctgctctcaaatcgctgggctcaagtgatcctcccgccttggcctggaaaagagctgggcttacagataggagccactgtgcctggccacttaattttcaaatttaattaccctaattaataaagaagatctcagttcatatttatcggtctttggggtttcttcttctgcagattgcctgttctcatcattttccccttttccctttggttgtgttaaattgttaaattaaataagcaggaggccattggcctgaggctgtctctgtactttgagttcgtatgtaatggactacaacctaatttagcgtgtaaacaaaccaaaatataatttaggagtctattttttgtaacagagagccaggtctccaccaatcacaaacagccaagcctcaccaatcacaggcggccaaccgatcagaccatgtccaaataaggcaaagcccagctgtaacctatcaagctatttctgtattttacttccattttctgtctataaatactcactgcccactcagagatgagctctccaaacttctcctggttctgcatgctgtgtgattgctgtcattctttgcccaaaaaaactctgctagatttatttttgttaaaagtttttaacagttgtgtgtagttggaattgacttgtaggagttccttatgtctttaggaaactaattctctgtattgcaaatgtattctgctagtcactggtttgttgttacactttgcttatattgtattcaacatacagaagttttaaatttagtgtagccaaatttatcaattgctacacttcagggttctactttcttcatcttaattaagcaacatgtattttcccaagatgtaaagatattccactttagttccttctaaaagctgtaaggctttgcttttgttacatttagatctttgatccacctggagtttagaatatgatgtgacctaaggatgtactaagaaggcttttctgatttgataatcaataatcctattcatttaatactttttcccactgattttacttttctcctgctgatcttaaatgccgtctttgtcatacaaccagtttctctctctctctctctctctctctctccccctctttctctctctctctctctgtgtgtgtatgtgtgtgtgcgcctgtatgtgtgtgagagagaatgtgtgtgtgttatggggttctagactctgttctgttcacttcattagtttattgtctatgcctgtgccaataccacagtttgttaatggatatatgttttgaagaggttttgatatcaagtagaaagagccccagctctgttctatttctaaattatcttcccttctctttgcccattattcctctgtatggttttcagaattggtttaccaaacaccaccacaatcattgtttggattttgatggataaaatttattattgtgggggggggagtaaatttgcataacaataatattgagtcctcccacaagataaaaaacatcctaagcagagaaaaatcaattcttacaaaacatctgaaaatggttgtattttatgccctcatccaagcatgtaaagactgtctatagagcacctgctaagcttgaacttggctctctgacctattatctatgtacatttataacaactcccagctgtccatcagacacccatgttagatgtcgaaatgtggttcttagtgctgtttgtcagtattctacacagaaacccaggaatgcccaaaccctttcctgccaatcagcaccagcgacctttatacacaaaggacaatagaagaataaaaataagaataccactgtattaagatcaaagcaaacacccaatatctcagtgtaataattatctgtgaaaagtttgaatcatgtagcttaagcattttacccaagcaagggcttctcctccccctctataatctaaatcttggaacaacttagaggtaagcagaagagagataaaggagaaagaagactggcctgaagggcaaattctggtctaacttgactaaccaactttaagctcagaagaggtaataaaaaaaaaaaagatggagataaagggtggcctgacattaggtctgtaacaagaatcacaagaggagagagtagagactaggattctgcctaaagtacacaatatccactgcatctagtaaaacagcactcaattaatattataggtgccaaccaaggaatagcacctcctccttccttgagtagagagttaggaagatggcaatggaagtgaacttggtataagcagatgcaccaactcggattccctccctcaaatttgttcacaggccattcactcactcagttgttgttcaatcatttatttctcaaacactgttaagtacagtcagtcctcactacccacagattccaaatttgagggatcacctgtcttggtctattttgtgctgctataatagaataccacagactaggcaatttacaatgaacagaaatgtattggctcatggctctggaggctgggaagtctgagattgaagcagctggcatctagcaagggactacttactgcttcatcccgcaatggaagggcaaagagaggaggacagagagacaaaagggaaccaaactcatccttttataaagaaccaactcccaaaataacaaacgtactcctgtgataagagcattaatccatttatgagggcagagccctcatggcctaataatctcttaaaggtctcacctcttaatactgttacaatggtaattcaattttgacaggagttggggaagggggtaaatattcaaaccatagcatcacctgcctactataatttatttatgatctttaaatgctttggaggtctttgcagataaatgaagaagaataaaaaagtttgaggcactcaacatacacattcccagtagaggttaaagcaacactctgccttcttgcttcagctctcctactacaaataaatgtccttcttgcaatcaacttagtcccatatttttgcatcatatatatgtgtgtgtgtgcatatatatatatgacgcacatatatatatatgcacgcacacacatacatacagtatatatactatatatggtatatatacaccatggattactattaagccattataaagactaaaatcatgtcttttgcagcaacatggatagaactggaggcctttatcttaagtgaaacaacttagaaacaacttagaaacagaaagtcaaatactgttgtgttctcacttataagtggaagctaaataatgtgtacacatgaatgtagagagtgaaataataaacattggagacttggaagggtggaagggtgggaggtaggtgaaggaagagaagttacttcatgaggacaatgtatatcccttgggtgacagttacactaaaagcccagacttcatcactatgcaatatatccatgaaataaaactgcatttgtaccctttaaatttatacaaatttatttattttcttttattatactttaagttctatgcagaatatgtgtgcagaaagtacaaggttgttacataggtatacaggtgccacggtggtttgctgcacccatcaacctgtcatctgcattaggtatttctcctaatgctatccctcccctagccccccaaccctctgacaggccctggtgtgtgatgttcccttccctgtgtccacgtgttctcattgttcaactcccacttatgagtgagaacatgcagtgtttagttttctgttcttgtgttattttgctgagaatgatggtttccagcttcatccatgtccctgcaaaggacatgaactcatcctgggaatatacccaaaggattataaatcgttctactataaagacacatgcacacatatgtttgttgcagcactgttcacaataccgaagacttggaaccagcccaaatgcccatcaatgacagactggataaagaaaatgtggcacatatacaacatggaatactatggagccacaaatttttttaaatgtcgtaagaggtaagactagattgggtgccagaaaacctggatttgagtccaggttctcctacacaatgaatctatttcttggatatatcatcaaatttatcttggccttcattccttcatctataagactgatagcttgccttctaagtcggaagactgtccaggagacaaaagggtgtcctttgcaggaacttcaatatgaatggcagctgctggagttatgtagggcactaccagtgcaggttaatgcagagaccctgcctccagcatgccatatttcctcattttcaatgattacaatggcatttgggttttcttcatctctgcaagcttaattggatcaagctctctccccaatgcctcagaagatgttctgtgtttctgtgctgatgtaggaagtttcttgacctgtaagatcctggaccttgataaatccattcccaaaataaaggccactatgtggggtttcttgtgagacagttaaaattctgctgattcctccctgactttactgccaactgcttttacattctaacagacggtctgaccttttcagagtctccgtttcctcttctataaaaagaggatatgcaacaattggaattccataccaccgggatagaacaaacccattacagggtggggacgctttctttgcactcttagaaagtttaaattcataacacatgctcctgtcttcagccaaagtgtaactccaaaattgtttaatttacatttaattatttattctgctgttttgccttctccagttactaatagataattgcataagaggaaatgaaatccaatacacaatagtagtgcgagatcaatttacaggcaaattcctggcttggaaacactgaaatgggacacaagtgattcagtacaaagcaagcagggagatggtacccccccacacacagccctttaattagatccttaacttatttaatgacacctctgggtctggaaagctgttattgtttaagcgtttaatgtaccatacaattcaggggaaggagattgggaaggaaaacgacaaaatgcttttaggactcaagttattggtgtgacctgcctggcatccccaagcaatcctggtgatgacattttgcgttctttcccccttctgtgtgtcagatattggtggaaagacgcttccggaaacgctgtgcagcaattgccctcaaaagtttattttacaacctagcaatgatgtatatttccacttcctgcctcagcacattcataatcaacaagaagtattgttttccctgcagttattcttcaccttgggtaaaaaaaaaaaaatcagagtccaagaagaatgggcaagaaatgcaattattggccaggcacagtggctcactcctgtaatcccagcactttgggagggtgaggtgggtggatcacctgaggtcaggagtttgagaccagcctggccaacatggtgaaaccccatctctactaaaaacacaaaaattagccgggcatggtggtccatgcctgtaatcccagctacttgggaagctgaggcaggagaatcacttgaacccaggaggcagaggtgcagtgagccgaggttgtgccactgcactgcagcctgatgacagagcaagattctgtctcaaataaaaagaaagaaaaaagaaatacaatcatttttctaaaaccggatgtactttattaccagattttattttaaatggaagataggagcttgctctcaataactttgaggtccccctcccgctgcggttgcctctaagcatgcttggtttcaactctccacgcattcatcaacctgtttccagtgcttgtctttctgggtgagggtataggaataaaatgcaacctccctatcagaacaagcatgtattctaggtgagcagtgtctggattcaatcatcttctttctgctcttctcactagagctgtttctattgccggcagtgtctcattcaatatatttttctgtctacatttagcttctccttgtatttctcctctcattccagttatgcattctttgtgaccttttccacatgaatcaaacaccagagattataggtaagagagctgaaaacacgggcgagaactctgagacaacttaatagaactctcagctggtaaagaaactcccacaggtaaagaaactgaggttcagggacatgtttgggccagaattgggactagacgccagggtatcccagcagccaactaatcccccctcactaggaataaatagttccaattttcctaacatctgaggttgagaggtggggcgcatcaactgtgacatgtctgagctgcatagaggatggggtattgtgttccaatgcagctttttctctgatggaaaacctgaaattcttcagagacgtgcgtaactaacgtaatcactgtctttgggcagggggctgttccctgcctcaatgttctcatctgtaaaatgaagaaaacaacagtattctcacaagaattaaatgatacaataaagataaagcatttagtatagttttttgtttatttgtttgtttgtttttgtttttgagatggagtctcgctctgtcgcccaggctggagtgcagtggcgcaatcttggcccattgcaagctccgcctcccgggttcacaccattctcctgcctcagcctcctgagtagctgggactacaggcacccgccaccacgcccacctattttttttttttttttgtatttttagtagagatggtgtttcaccgtattagccaaggtggtctctatctcctgacctcgtgatcctccggcctaggcctcccaaagtgctgggattacaggcgtgagccaccgcgcctggccagtatagtttttgatgtagagtaagtgcttaatagacgttagttatcattaaatcatcattaccatcatcatcatcatcttatcacttattgtttggagacctctgttatactttgatgcttgaatcattctgtaaaacagcagtaccgctggaagaattcttccagtcattcattgccagatatttatgtaaagggtaattggcaaaatagcacttccttcctctgcatggtgggaaatgatgcccttgttagcttttctttcctgctgggaaaatgctaggccataaataaacattgaaatatgaaatactcaatgaatgaatgaaaataacatgggggtataactagaaaaaaagtctgcaaaatgttataatcaactttgagttttaatatactattaacagtgacagaaataactacaaagagggctcacagaccagacaaatttcctctttggatggccaaacatctgcagtaactgttcttctttattcttctccttcccagcctaaaggatttggtatacctctgttaaggcctgaagatgtgtttgcctggagtaactacagccctctacaaacaaaaaatgaaagtcggaaagtgaagaattagggttgccagacaaaataaaggaagcacaactaaatgcgaatttcaaatagataagagaattattttagtacgtctcaaatactgcatgagcatctgttattttgatacttggttttgctttgttttgtttctaaatctggcaacccttcaaataatacccattttccctatttggcatataaaacataggtaatttagtagtctgtctggcagtgtctggtaagaacttatttggattatgaagagatgaaacaagaccactgtacagataatcagggatctccctgagaagaaatagaggtggcctccacaggctaatgaatccatcgcctgaaatcgtaccacttacagaacgggttaaggtttattttgaaagaggaagaattagaaaagacttagatttgagagagtgtaacatatttatagaagcctatttttatgaggtatttttagactagagcgttacctgattcccatggggaattctatgttttaataaactccaaagactcaataatgggatattatatttgtgctaatttcactatcccaatataccttagtatttgggatatggggagagatattctgacccaaaaaaattatgtgccagacatttaatacacgttacttcagctagtccacagaacaaccctgtgaaatataaattggggttcagaaagttgaaaactaactgaaaaatgtgtacataccatatgacctactaatgccaccctcggttatttcccctcaagaaatgcaaactaggctgggcacagtggcccacagctgtaatcccagcactttgggaggccgaggcaggcggctcacttgaggtcaggagttcgagaccagcctgggcaacatggtgaaaccccgtctctactaacaatacaaaaattagccgggtatggtgacacgtgcctgtaatctcaggtactcgggaggctgaggcaggagaattgcttgaacccgggaggcggaggtttcagtgagctgagatcgcgccactacactccagcctgggtgacagagtgagactctgtctcaaaagaaaaaaaaaaaagaaatataaacttatgttcatacaaacacctgtacacacatgttgatagcagctttacttgcagttgccccaaaatggaaactttattcataattgccccaaattgcccctaaatgcccttcgatgggtaaaaaactttagcaaactgtggcacaccgatacaatgaaatgctattcgacaatgaaaaagaatgaactactgatatacacaacagtgtagatgaatctcgaaggcatcattttgagtgaaagaaaccagtttcaaaatgttacctactgtgtgatttcgtttatatgacattcttgaaaagacacgaccatggtgacagagaacagaccacaggggttggcatggggattagagcatgactaatactaggatagcaggacggaggtttctggggtgatggaacagttctgtattctgattacggtgattatataaatatatgcctatacagtcatagaaccgtacatgaaaaaatcagttttactgtatgataatgttaaaaaataaaattaacttaaaacacagaactagcaaatttgaggattggcattcaaatcttggtcacttgaaccctgtaagaactccctaaaagcaactataagtcagttgacaacatgtttcaagatggcaaggatactgatacatacatatacatattatacgtatatacacacgcacacatacacacacacatacatacatacactacgtatgtgtgtatatatattcctcttccaagtgcttagcatagcgtctggaaagttctacaggaatagcttgaatttttggcctgtaatactctatttgcttaattgctcaatgcccctgccagctgggagcttgactaatcacctacgctaatataaagtcagtgccaatggaagctgtcatttttctgtccttcagctggaggactttctttttttttttttttttgagacggagtcttgctctgtcacccaggctagagtgaagaggtgcaatcttgactcactgcaacctctgcctcctgggttgaagtgattctcctgcctcagcctccccagtagctgggattacaagcgcctgccaccacgcccggctaattttttgtatttttagtagagacggggtttcaccatgtttagccaggatggtctcaatctcttgacctcgtgatccgcctgcctcagcctcccaaagtgctgggattacaggcgtgaaccaccgcccagcctcagttggtcatggttttcacctgacctttcccttgagcccctggctcaacagccccatgtcaatgtctactagtcacctcaaactcaacatggcctaaacagaactattgagttcctgccccctacataaaacttcaaacaaaaaaactccaaattaaagcaatttttctttcccatgtcagtaaatggcaccaacattcatccaggtgctcaagccaaaagctgaatatcactcttgattcctccattccctcacctccccattgccagctcatccacccccatcaaatccatcatcgtctctccatctttatccctctcatcctgatccccatcttctacctggaaaactgcaagagccttgtctttgacatcccagcttccacacttgccctgctatgggtcattttctgcagaatgagctggtgttttaaattaaaattgcatcatgccactaaagccctacccttcttcctttcatgcttcaagtaccactcattgcctggactgctatgatttgacccttcctcacctcactgatcctctttcaaatgtccctttcacataggcttcaggcacctttgcttttatactggttatcaaatatgccaaactacctcctactctagtgcccctgtcttcactgtcccctcagcctggaccactcttcccctagatcatggctagtttctccatttcatgaaggtctcaccttaaatctgacctctttgcatgcaacttatttaacctcccaatccagagaagcctctttcagatcaaagagcatttattattttcattaaataacctgatattcttatttacaagaataagttgtctgctgttctcctctggaatataacctccatgagtacagagttttcttctgctatagcctcagtgctgagaatgctgcctgacacctagtaggtgtgcagtaaatgtttaatgaatggattggaaagaaaatgcatgcaatgtatgcaaagaaaaaataattggggtatccttggagaaactctaaaagactgcgtaagtgggctgacagattccagaggacacatttaaagaaaaaaaatccctaaggtacaaaagatttcagaaaaaaactacagtccaggggcaaaaaatgtccttcactctctgtgttaaaacttcaaccccaaacacttgggagcttcttccctcaaccaatcaggtacctcctctgagggtaaagagcatggcagatattccaaaaatgaattagtatgtttattaggtcacatcccccgagacaaaccacttgtctcatcaaatttacagctgtctccaaagcatggaaaatcctctccaatcagcaagttacatgggccgacttaacatattgtacaatgttgatttatggtgacaattaagaacgtattaccaaagtctatttcaccattaacacccctggggactgaataacttctaaatcttccggctgctacctcccaaaaggcttggatcttggctaaggatttagagattataaatttaacaaaggatgaaaactgcaagaggagagtcttgaacagcaaataatgagtttaaccagcttctcaacttctcggtgagatttataacgccttcctgcctgagggcaaggaatcttttattttgaagtttatagcctctatcacttattgttttagctccagatgtgagagtctggcatttggatgggattctttttggaagccagtattcatcagttcagcaaatctttccttctgacagtctttttggagaacagtacagtgaccagaaggcaacgactgtcacttccaaagataggcacctactacttcaacaagttgctggatgtacagaccctgcattgcatattcatctgaccaaaaagcccaaggaccagacttctaatagtctgacatgaaataactctaggactaattggttccatggttctagagttggattctcaccagtggtgcagctgggtcacctttgtgatcaccagtaccagcaaagaaacatgagccaatcattatctacgtagggttgaactggccaagtttgagtgccaatcacatccaggtcacattttcccaaagtatggatcagagaccatcggaatcacccggggtgctttcaaaggaagaaaaaccctctataccaaacctacttaatcagaatctgtggaatttggagttaggaaactccattcttttttaaaatattatttatagaggtggggtcttgctgtgttgcccaggctggtctcaaactcctggactcaagcgatcctccctccttggcttcccaaagtgctgggattacagatgtgagccaccacccccagtcggaatctccattcttaacatgctctatagattattctcatgcactctaaattttgggaaactcaagctttgttgtaatgcatgcaacccaacctggaaggacaagtcacctactctgggtggagacctcaagtgccaccagtaagcatctctctgcctttcgttattttcttctgaaaatgtaactcatcctcagggccccatggagagaaaggaagatgaaattcctgaggagagttcatctctctgagatatttacctttcactggaccacccactagcataacatttctgtacaatcatgctcagctttgaggtgaaatacgtgtctacaaaatacttggcactcttcaggttgttagaatatttttagaaatgaaaataacttgagaactcagtaatgaatatacaatagaagcatttcaggtatcatgaggttggtggaagaaaaataattttactctatttataggcagaactatctatcctctctctgactctcccccagaggagaatcatatgaagtttggctcctaggacatgtattagggactggaaattcgtcccatatgtgagtccaaatttcaaagttatccagtaatgaggatttcagagtgtggcattttgccacggggtgaactgaccaccaagtgcaataagtgctacgtgcaagcatgcatacacatgtatacacaaataagcctgggaaaggtactattctgtttggcaggaattggcagagaatagtggttcaatgaacacaaagtttatagattccagtcaccagaatctatctatctatcttccttccttccttccttccttccttccttccttccttccttccttccttcctttctttctccctccctccctccctctgtcccttccttccttccttccttctctctctctctctctttcttctttttttttttttcttttttttgagatggagtctcactctgttttccaggctggagtgcattggtgtgatctcagctcactgcaacctccgcctccccggttcaagcaattctcctgcctcagcctcctgactagctgagattacaggcgtgcaccaccacacccagctaatttttgtatttttagtacagacagggtttcattatgttggccaggctggtctcaaactcctgacctcaagtgaccacccgtctcagcctcccaaagtgctgggattacaggcgtgagccaccgctcccggcctactctggttaccagcatcttaactataataatcaaaaagcatcaataaacatcagatattcgactgtaacatttctcttacaagttacagtttcacaacgtgacttggatgtgatatggcacactgatgtgactattgtggtgactaacatttgttgggacttttacatgtgtggtaggtgatcgtcactaccacgtacgagttaggtgaactttttaatcttcattttacagatgagaaaacaaaacatttaactgacctgccaagattatagaggagagaagtgagggagatagggttgaatccagatggtctcactccagaggcaacttcttcagtaaagggccacgtaagtaaatgttttagtctttgtgagtcaaatggtctttgaggaaaggactcagctctaccactgtggcatgaaagcagccatggacagtaggtaaacaagtaaatgtcgttgtgattgtgtgtcaataaaactctatttacgggcaccgaatttgaatttcatgtaattttcacatgtcttaaaatattactttggggttttttttttcaagtatttgaaaatgtgaaaactatcattatcacatggtccatacaaaaatgggtgatggggtggattttgcctgcaggctgtagtttgcagaccccgatctaaagtattgacccttccaagatttagatcctgccttttcctaccattttgtagttgtgataacttgagcaagtcatttaacttctcagtttgcttgctcttagtcacttaatcttttaccttgatcgatggtatgcagtcagctattcatacattcatatattcatttaacaaatatttattgaacccatgcactgggctagatactggaggtgctagattttgtccctgccctccctgagcttacatttcagaggaaataacagataaataagtaagtatcttactttcaggacaaccaaatagggtaaggagctccaaccctatcaaaggcatcatggggaaattagaaagtagagactttttggacatgggcagttccatgccaggagggggacctcaaatcatactttcacctctcctgccctagactgatcctcttgggagagcactgaattatctaaattacagaacctagtacattgctctaattctttgacaaaagatgaatttgtttttcattgccatgttacaagttatcatacacttagcagcttaaaacgacatatatttattatctcaagttttcacagatcaggagtctagacaggcttagctgcctcttctgctcagagtcctatgaggctgtcaatgaggcatcagttgggctgtgttctcatctagaggtttgagtagagaaaaatcagcctccaggttcattcggattgctggcagaattcattttcttgtggctgtagatctcatggtggcttgcttcttcgaggccaacaggataatgaaaatgagtgttctcagagtcatatatgtagtaagatagtgagggccatgatatcccatcacctttgccatacaatataattcaatcaagccagtgacatcctatccatcacctttgctgtattctgttggcaagaggaagtcacaggtcctaccacatggaatgagaggggatcgccaagacataacactagaaagcggaggtcactggggttgtcttggaatcctacctgccataaaatatgccatctgaaacataggaccgatagtggtgcctgggtcaaagggttgtcttacatttaaagagcttaaaacagagcctggcacaaaggaagaatcttttttttttttttttttgggacagagtcttgctctgccacccaggctggagtgctgtggcatgatcccagttcattgcaacctccacctccagggttcaagtgattctcctgcttcagcctcccaagtagctgggactacaggtgcaggggcaggccactatgtttgggctaatttttgtatttttagtggagacagggttttgccatgttggccaggctggtctcgaactcctggctgcaagtgatctgcccacctcgacctcccacagtgctgggattacaggcatgtgccactgtgcccggccaggaagaactcattttgttttccttatcatctgccactatcattattaagaaggttccagccatgtctcacacagctcagagcatcctttagcctcttcaaggtgatttgggatactgggatactcctgtgcagagagcaacttcccttctctacctccagggatgtctatgcaacacttactgaatccacattacctctgacatcttgaacttctcacgctggacctaacagctctgtgccatctcattttctaggtggaaatgtttccttcagagatagggtatgtcaacttttgcccataacctctgagctcccaaattccaattttctttcattcaacaaattcatcttacaatcttttattgtgtgcctactatatatcaagtgctaggctttctccttctcagtaggtctgtgccaatccataaccccagaactttttctcattttgcctcttttaatttggcaaaaattaaaaattaaattaaaaaattaatttttaaaatattaaaaaaattaaacatttggcaaaaatctgtcgctttttcccattctagttaagattaggtttgtgttttaagggcattagctgcagctttgtgctgttagagaaatagtgcatcttattgacctgctctcttattttatagaactgcagagaactggcctggtgcggtggctcacgcctgtaatcctagcactttgggaagctgaggcgggaggatcacgaggtcaccagttcaagaccatcctggccaatatggtgaaaccctatccctactaaaaatacaaaaattagctgggtgtgatggcacactcctgtagtcccagctacccaggaggctgaggtgggagaatcacttgaacctgggaggtagaagttgcagtgagccaagatcatgccactgtgctccagcctgggtgacagagcaagactccatctcaaaaaaaaaaaaagcagaaaactaaagtttcttttctctcttctctccatatacacacatatatattttttttcctactgccttatctgccttatcctgccgtttagattcaaattgctccctgcctcctttctaagtgattcccctcaaaaacctggaaaattagttgacgggttttttttcttttttttcttttttctttttcctttttttttttttttttgcctctgatctcctagaaattcttttagcaagatttccctcaaactacaagattcaagtgattgtcactatataattagtaataatagaactattaataatgatgatattaataacaagtaatactgctagagctcttccgatattccagggtatgctctaagatctttgtacattttagcctatttaaccctcattttggatatcaggaaactgaagcgtagagaaattaagtaactcgtcaaaggtcacacgacttgaaagtgacagctgagattcatgctcaagctaattccaaggtctacacttttaaccactatgtaattttgcctcttcacatagaccatgagaaaaatgttagtggaaacagaattccatatccagaaatagactatgagaaaaatgttagtgaaaacagaattccatgtccagaaatatactttgaatccaaatgacagggcaaggtagtagggtaatacggggagaaaaaggaaaaattttaacttttcacccctatgaaatgcgactgagggtcaggtcaataggctgggctctatctctgatatctcaatgctctaaatattgcttttaccaaatcatcccagatgaagtgcaacatgagaaaaagtgatgctgaatccaagttaaaacagtcatgatgggagagggtatggattcgccagaactagagtcaaatcctagtctaagacttaatacccacttgaagattgggggacaagaagtgtatgcccaatttcatttgaggaaataaatgtctgttcctaaaatcaagctagtaaattacaaatggattctatgggtttttttgttttgttttttgtttttgcagttgcaagatttaatagagtgaaaacagagctcccatacaaaggcacccaaagagggtagctgttgccagctctaaggcctgggtttatatcccgatcattgtccctcctgctgtgctctcaggcgatagatgactggctgtttccttacctcctgttttcgcctaatcagtattttagtgagctctctttactacctgatttgttgggtatgagctaagttgcaagccccgtgtttaaaggtggatgtggtcaccttcccagctaggcttagggattcttagttggcctaggaaatccagctagtcctgtctctcagtccccactctcaacaggaaaacccaagtgctgttgaggaggttggctgatgaccactctaactgcttcctgatgaattggggcatagtaggggtcatgcagttgagatttccttgggaggggtgccttcggtgtcatcaacatcggagtgtgggctagcagaccagtccaggggtccatggtagatcttagtcatggactgcatctggggctccatttgaagaacctacaaatggattcttatccattaattagaacatgctgctatgtctaagatacatattctagatagtgatattatttattttattttatgtttacttatatgtattctagaaagggatgttatttattttattttacttctattgctttatattttttcaaggcaacaaaatcaagatatacaaaattataaataatatttaattattaaatattataatattagcaccaggtgtggtggctcacacctgtaatcccagcaactttgagaggccgaggcaagcagatcacttgagctcaggagtttaagatcagcctgagcaacatggtgaaaccccatctctacagaaaaaaatacaaaaaattagctgggtatggtggcaagcacttgtagtcccagctatttggaaggctgaggcaggaggattgcttgagctgtggaagttgaggctgcagaaagccatgatcgcaccactgcactccagcctgggtgacagagagagattctgtctcaaaaaaaaggttatagtattagtactcaacatgggaaatttcacttcatttcttttttaaaataattaaaactttttttttttgtaatatttggcaggagaatccagtccatttattcagcaaatagttacttacattgtattagtccattgtcacactactgataaagacatacccaagactgggaagaaaaagagttctaatgggacctacagttccacatgactgaggagccctcagaatcatgacaggagatgaaaggcacttcttacatggcagtggcaagagaaaaaatgaggaggaagcaaaagcagaaaccccagataaacccattagatctcgtgagacttactcactatcatgagaatagcacaggagagactggcccccatgatttgattaactcctcctgggtccctcccacaacacgtgggaattctgggagatacaattcaagctgagatttgagtggggacacagccacactaaatcacacattcacaaggataatatttgctatgcttctacattgagccaggctctgtgctaaacccttggtctagaatgggttatctagaccagacccattctttaagcttcaggtgcttactctctactgagtattgaaccataggagactgcaaatattcaatcattttttacttataagaatggcaatttcctataatccaaccttataataaggaaatatatcaaatgattacacaaatggaagtacaattataatgtgagataacagccatgtaggaaaatgtaaggttctacataaatcaggaaaaagacaaaaggctagtttcggaatagtgttggagattcttcttttctaccccatgttgctttccaagtgcagagagttccattaatcaatcagtcctaacctccctccatcttcctcccctggaaaattagggagagaactgctgctgggccccttccttctccttcctcttaggagctaaccactacagaaaacctgctttgctctgttcctctatgcagtgtttttgttttgttttgtttttattgtggtaaatatatataacatacaacttaccattttaaccatttttaaggtacagctcagtggcattaagtacattcacattgctgtgcaaccattaccaccattcatctgcagaacttttatcatcttccccaaattgaaactctgttcccactaaacaactccccattctccctctctccagcccctggcaactaccattctgctttccgtctctataagtttaacaactttagatatctcatatgagtgaaatcatacagcatttgtatttttgtgactggcttacttcacttagcataatgtcctccaggcttatccatattgtacaatgtgtcagaatttcctttctttttaagactgaataatattttattatgtggacatatgacattttgtttcatttaatgacattcatttatcaatggacattggaattacttcctcctttggccattgtgaaaaatactgctgtaaatatggatgcaaaaatatctgtccaagtccctgctttcaattgttttaggtatatactcagaaatggaattgctgaatcacatgaaaatttcatttttaattttttaagaaaccaccatactgttttccattgggatcacacaattttacctcctcactggccatgcacagggttccagtgtttctacatcctcactgacacctgtattttcctttaaaaaaaataataaaagcctttctattccaaggggtgtcaagcggtaactcattatggttttgatttgtatttccttagtgattattgatgttgagcatcttttcatatgcttttcagccaattgtataccttctttggaggaatgtctatacaagtccttcatccatttttaaatcatgttttttgtttgcttgttgttgaattgtaggagtcctttatatattctggatatctttctcttatcatgtatataacctgcaaatatgttctccaattctatgggttgccttttaagtgtgttgatagtgtgctttgatgcacataagttttaaattttgatctattccaattgatgtatttttccttttgttgcctatacttttgatgtcatatcacgctgaagttttacaaaggcaggcccaccatggggcatcccggggggtctggtgatgcctgtgactaagtggtaagtctagttaattctggattcagtataaaaattttacccacagaaatgagccatattttccaacgtcagtttttctgatttaacaaagatgtattttgatctccatctgaatcactccttgactttttcttaatttgtttagtatcaacttatgcccccatccaaataccaaaaggaagctgggcatatgcggtttttggaacgatatctcaagaatgcatagaagttaacaatttaagggaaaagacaagagtagatcgttcaaggcagggcaatgaaaagagagtatacaaatgtcctatagtaggagaagtataatatgattttacaaaaacaccaaaaaaaagcctaataaaggccgataaaaagcacagagaagagaacaaaaagaatggggtgaaagatgaggttccagacaggagcacagccagggtcccacaccggcaggatcttgtagaatattgtgtctgcccttaactagaaagagttaagcctatgatccttaaaggtttgcttaccctcattcctgagcataagtaatgaaagcatcagatttcccctagaaggcgaagattcctattgaacaatacagataagcatgccattttgctgccaccaaagccttaggtcagaaatgctttaattggctaagaagattcccttatatcaaaaacaggaaaacaaaatcatgaaaaaaggcaacacaaattaaactaacaaaataaagtgcttggagtgggaagacatcattattattcccctaaaattgtccaaaaactaaaacaaaaaataatcttcccaaaatgcatttggctattagaaatataaacacttagctgggcacggtggctcacacctgtaatcctaactgggacgccaaggtgggcagatcacgaggtcaagagatcgagaccatcctggccaacatggtgaaaccctgtctctactaaaaatacaaaaattaggccaggtgtggtgactcacgcctttaatcccagcactttgggaggccaggacacgcggatcacctgaggtcaggaattcaagaccagcctggccaacatggtgaaattccgtctctactaaaaatgtaaaaattagccgggcatagtggtgcattagctgggcacagtggcctgtaacctcaactatgtgggagactgagccaggagaattgcttgaacctgggcggtggaggttgcagtgagccaagatcgcaccactgcactgcagcctggcgacagagcgagactccatctcaaaaaacataaaaataaataaataaatataaacactttgtcctagtctttagaaagggattagaaaaaaaaaagaaatacattgataatactttcctctgaacacctcaatcaacccatagtagctaggactacacagagctacattatctcgtttaactctcacaacttccccaagaggatgggtactaccattatccctattttgcagattagaaaatcaaggcattaaagaactgaattcccaagagttattctactaatgcataatgaattggttaaaaatcaggcttgtctgttgccagaatttatgttactaaccattataacagccttgtttgcacaaattctatcccagagaaaagaacaggcatctttggccagcttagagaaaggacccttccctaaatatgaggagattttcacattgtgttgtcccttcattcagccaattccagatcctgatgagagacctgaagagtatgcacagactctgctgagtgactgggaacactgagggggaaagggaagatggacaaactgtaaagaatgtagatccaatgagaagaaaaaaagactaggaatgaaagaaaggggaaaggggtcatcctcctcccaaaagcgtatccattttaattaagctagttatctgcagttgcttttttatctaaacattagcttctcccacctaaagattgaaatgcagaattaaagagaggtattttaaaataagattagtccttcctcattcgtttattctctaacattaatttacagagccccttctccatgccaggcactcgtctaggcagttgggatagatcagtggatgaaacaaatatcccttcctatgtaaagtttacatcctactgaagggagatagacaataatcaataaacaaaataaataaaaaatataaaatgttcaatagtattttttgaaaagttgattaataagggacatcaagagtattggaacaggaagaggaagcatagttgcaggagtaatatgtcctcattaaaaaagtcctcatgtagtgctcaagctgccccttttgtgatcactcccttcaggttgtttttagtcaagtattacctcaaacacattccctttcaagttttccttggtcctggcatcaggtgcaggaggacaatgacatcaactcattctcaaggctggggccaaaggagaccataatgtgtggcaggactgctgaatccaaccaagaagaggactgactctgtagcttcttttttgtgacttatccccagatatccctggatggaaggggaggagaaaaacccaacctgaggaagccagcccatgggggtacagacctcaacgtcaaggtggttataaagacagattgaaagaggaacccatgcctttttctacccacatttatcttcactggctgggagagagttagcctagacagcaagatcccatgggctggggctaaaagagtgtctcttcatccaaaaccatggatgaggatgaggatgatgatgatgataagatgatggtagtggtgatgataaagatagtgagggtaatgataatgacgatgatgatgatagtgattatgaggatatgatggtgatgatggtgatgataatgatggtgatgatgatgatgatgttgatgtgatgatgatgatgatggtgataatgaagatggagataaagatgaagatggtgatgataatgatgatgaagataataatgatggtgatggtgatgatgatgatggtgaagatggtactaatggtgatagtgatgatgatgatggtggtaatgagactgacaatgatgacaacaacaactattactatgtatcatgtcctgggcctagcactttatgaacactaaacaatcagcttacatgacaaaccaatgagaaaaatattactattatccccattttactgaggaagacattgaggcttctgagatacttatttttgtctcatagaaaataagtggcaaaagccagatttaactgtataacatctgggttccaaaatggaatcaggagagtattgatgggaatggagatacaccatctggtaagccataaaagagagacagagtagttggccaaatcaaagaaccacaaataaaagaaaaactgtaatattagatacatgatatagtttggatgtttgtcccctccaaatctcatgttgaaatacaatccccattgctgacagtggacctggttggaggagtttggttcctgggggtggagccctcataaatggcttcatgtcctcctcatggtactgaatgagttctcactctatttgttcacatcagagctgattgttaaaaggaggctggcacctcctcccttctaccttgctccctctctcacctgtgccacatccacaaccccttttgccttccaccttgattgtgaccttcctgaggccctcaccagaagcagatgccaccactatggttttcatgcagtctgcagaaacatgagccaaacaattttctttataaattatccagcctcaggtattcctttataacaatacaaaatggactaataccatgcatatttgctgccttcccttttcctcctgtttgctaaggatgtacattttctgggtctaagtagtgagtgacaggagaggcagattacagaagtctgaggggcaatgttaatctaaaaatataaactggaagcaagtaggttagcaagaccaccatgcacacagtggctgagttgagaattaaaagttctggatttgagaaagtagaggagaaactatcttgaggaccaatgtctcgagggaaacagggagaggaggctaggataaaggtctgctctaggttgtagatggaatttcccatgatatttgttgagaaacttcagtaaagatgtgaactgggtcttcttcattcaacttttctttcactgttggggctctttcctggtgtcattcattcagggaagatggggcctcccaactagctctccccagtcagttctcccttgtcatttccccccactttctatttttcagtctgtagccagaatgatcttttaagacatatatgagattgcctcgttatccacaacacacactttaaaacctatgcatcatgagagatttaaactcctgaacatggttgataaagttctctgtgatctcacctctgctacctcaccgacttcatctctttgtcatttgatctcttaccattcttcaaccactgcctccttttgaattcaccttgctcctggccacctcaggggctttgtatgtgttatttcctttgtttttagttaattcctatccactttccacatctcaactcaaacatcatctcctcagaagacttttccttgaacaccccctcatgaaccccagactccagcaggccttcctgtcatatgtctcattagcccttatgtttttcattgcattgttatcacagtttatgtgtgtgatccatgctctccttagactctcccctgtaactctcattaaagcaaaagagtattttagttactattgtatattcaaaaattagcacaatgcctagccccctccacccccaaacatgagaaaaataaatcgggaagagtggcctcgggtttcccgtcttaacctgagctttgagaaacatagatatccacaggaatgctcttgcctggtgtggtctctttgctgagaaaaactataagccaacaatgtaggggcttctgcagggccataagctaaatatgaataaaacatactttagaacatgggaaattcatgtcatataacagagtaacatctggtttcaacatcacttcattcatttaactacctgtgttgaccttggacaggttacaaaggtgatctgagacttttttttttttttttttttttgagacagagtttcactcttgttgcccaggctggagtgcaatggcatgatctcagctcaatgcaaccactgcctccccagttcaagtgattctcctgcctcagcctcccaagtagctaggattacaggtgcctgccaccacgcccggcatggcatatttttagtagagacggggtttcaccgtgttggtgaagctggtctcgaactcctgaccttggatgatccacccacctcggcctcccaaagtgctgggattacaggcatgagccaccgtgcctggccctgagactcagtattctcatctgtaaagtggggttaatgatagcccaggccttactgtcttgttgtgaggattcaatgagataacacatataaagggcttaacacagcacttggcacatgcaatactccattattaatggtagctatgccaaaccagataatctacatcagggctgtccaatagaacttgccacaacaatggaacattcttctgtgctgtccaatacgatagccattagctacctgtagctattaagcatttgaaatatgactagtgtgactgaggaacttaatttttagtttatggctggtggccaccatattgaattgcacaccactctagactggagtcttcactctctggttctgaggggtggtgctgtccctggtgctaaaattcttgatgttcagattacttgttcgtttcatgggcaaaggaagcactcctttgtaaatacctctgagtagcttccatatcactagacaacagctgttctatggcttctcggagaagcttgatgtagtcacaaagagtgagcaataagtcattcttactcctctataattccaaattctggttatggtaatagctagtacttattaagcccttgctctgtgacaaagtccatattagaggtttgtctcaatctgcttgaaattctctgaggtagaccccattacaatccccattttgaaggagtctgtttagaggtgcacaactcataagcggcagatcctggatttgaattcaagtagcctgattttggagtctgtgccataaccaccagctagactaccttctcatactatgttccagtttgtcaacaacagaaatgaactctatttcacttaaacagtaaagggattattagaagtttccccaattgctcacagaatcaaagagaaaattagactttgaaagtgggggaaaaaatcaagggaaaccaagtggccaaaatcatctaaactctcccccagaagagcccattaagagtgtctcagctgggcacgggggctcacgcctgtaatcccagcactttgggaggctgaggtgggcagatcacgaggtcaggagatcgagatcatcccggctaacatggtaaaacctgtctctactaaaaatacaaaaaaaaaattagccgggtgtggtggcgggcacctgtagtctcagctactcgggaggctgagtcaggagaatgacgtgaacccgggaggcagatcttgcagcgagccgaggtcgtgccactgcactccagcctgggtgacagagcaagactctgtctcaaaaaaaaaaaaaaaaaagagtgtctccacctcctctgcagctcgctgctttatgtcagtagcctgagattcaaggacctaggaagaaacatattattagctgaacttaggtctaaaaagcccatactctatcatccagagatcatgggaagcaaatactggccttccaggttctatagcagaaggagctgccaaggatatcttcaagatcagctataaatgattccctaaacatagtaaatgggttagacattgagtagccaaaaaattataaacatccactacctactacccttacctgaatccttataaatgttgtcattaatagcgtgtttttctttccaggctacaaggtattgcttctagccaagtaagcataatcaaagcccaggctcctcatctgagtatctttaaaccttaacagaaagtatcatttgggatttttttttctttaagtggttattttccatgctccaatcattcaagtgctgccttcacaattttctgtcatatgggtgcatcactgctctattatttgcttaatatttctcttcaaacagactctacattttacttgattcattttgaaaggaaactttatattactgctgagaacatggggttagcatactagctatatttcatcttctgatagtcattaaaataaacataaaactctgaatgttttttaagtttattcaggaaccatctaaaagcatcctctgctccagagacgctgctctaatacaaataaccaccttgcagttttccataaggttgcagtgatgtgagatggatagcaatgcccggagagaccaggggaagctcaatttttactaccagaattcagagtcagggatctctgggaaatctaccttagcattctctcttcttccttgtgtggccttaatcaaaccccatggttcttttgtttcttggcccactcaatgccagcacttgagtaattaacatgtaatacagccaagcacgcccttccatcacagacacacgtgtcctctgcactacccaaaatgctatttaggattaacatttatttccttctaaggaacagaaatcaaagtctagtttctcttgcactttctgtgtactgcctttatcccagacccaacaaactggcaggctaaccaaataaacacagaatcaaacaaacatgagccttcaaaacaaaaaaaaaaaaaaaaaaggaggcgaggagcacggggaagtggggaaagaggcaattctattcaggaatagactcttttctttccagttaaagcaatgagcacatctattgacacaacatagatccacctaggactacctttgccctgcaaagatataaatgctgcattaaaactactttctgtttgcatagaaagtcctgtaaacagacctgctgtgaatgcaaagcaagaaacccagctggaaggagaaaggcttttggaggaacctgagaaggagatgttagatttgtctgccctgtacaaagatttgctctcttctcatcttcctctctttctcccctgactcctcctcctctcccctcttccccgctcttcttcttttcctctttctcttcctcctacctctccttttcttcctccttctcctccttcttctccctttctctcctccttctccatcttctcctccttcctatttcttctggagtcgatgagcgagcaggtggccagaattcatggcctggaaaattctggatcccatcaacaaagatgctgtcttggaaaaaaagctgccatgctcgttttcccaaactgaaggagatgctctccacatctctgatcttgcatccaagaagtgggcagaccacaggaaattctttcagagcatttagccctaagttcccctgtttaatatagttgactgaattcattaatcaattaattagtaagtcacactgctccagactaatacatatgccaacgcagcaagagactggaaagacacaggggaaacgaggaaagtgaagaggcttcccctgcaatactggagtatttattttgagtgtagcgagttcagcaaacatctgtttattcagaatacgagcaaccagggaactcgaactaaccagaaaggtttctcagaattttaaaagaagagttgatgctcttaaccataacatgctcagcccttatgagattttgaagtgctctctgaatcaaaagatttttttcccctgtgaagttttacagtaaagtgtgttccaactttctaaaaatgagctgaaaaggtatgttttctgggactgttcccagttaagttggatattctattcaccaaataacccacttctcaaccattccagtgcacgtgggccaaggaggtggggaaaacaagatggaaaccatcataatgggcttatgctaggaaggctgtgttgtaatttaaagaatactgatctttgagtctagaaaactgcatggaaaccctagctctttggtttaccagagcagtgactatttgtgcaagcctttcagaacctcagctcccaatctgcatagtgaaaaaatcactttatctttacaaagtggctgtgagagtgaaataagaaagggtatgtatgaatgctttgaatgccatagcacagcactcacatgcaaggaataattactgtcatttataacaacacactctcaaccttgagttatcctctcattctttcttctctttttccttctctctcccgcttcctggggagcataatgatgtctgtgataactattacacatgaaaattacatctctccattagttctctttacagaataaatttcattgaaatccattaaaatatttcagacaacaagcctaccttgaaagtgttgttaatcactattttattttgagatgttagtctaagggggaaaaaaggggatagactttagccatttggtactaaggtggattttgttagaccactcctttcaaactgtcaccaaacagaaagatggagaaagaaagccggacaatcagcaaatacctggcaattaatccaaggtcaagatctctaatttgtttataaaggtggtaatgagttgggaagggaatgttttacctgaaattcagtatccacccaaatggcaagtttatactctgcttagtctcaaggtatggaaatgttttaaaactttttcatattattccttgagtctttagggattgagcctctggatggatggatggatggatggatggatggatggatggatgattatatagattatacagacagatgatagatagatagatagatagattagatagatagatagatagatagatagatagatagatagatagatagatagatagacagatatcgataggatagatagactcacatctataatccaagcactttgggggtcgaggtgggcagatcacataaggtcaggagtttgagactggcctagcaaacatggtaaaaccccatctccactaaaaatacaaacattagctgggtgtggtggtgcatgcctgtaatcccagctactcgggaggcagaggcatgagaatcacttgaacctgggaggcagaggttgcagaagctgcagtgaaccaagattgtgccactgcattccagcctgggtgacaaactaagactgtctcaaaaaaaaaaaaaagatagatagatagatagatagtcagacaacagatattgatagatagatgcagagataaattcagatgtagaaatgaatacgcagatgaattaaattcagatagagtatttctcctgtccatgagggcatgcaaaacaaagagaccaaagaaaaatatgcaatatggctgaaggaaaccaaaaaataatcttaccccaccttctcatttttaaaaggtaaagccctgaaaaggggattaacttaccccaggtcacaaagccagtactgccactgttattactaacagctgatatgcattagcacctacttgcactaggttttggacaaagctgtccaagtgtgatatcttatttaaccttcccaggacaatcagaatgctggtcttactgactagaaaactgaaactcagaagggtgaagccatttgtccaaggtcactcaactggtgagatgcagagacagacttgcaaccagaggaataccctgagctacactgaacctaagactcctggtttccaaactagtacaaggtccctttatatatttcaacctgaaattttaacctaaaatatttctttccttccactggtaattggaaaattcacttttgtaaatgaacttacaaaaaaataattaccttcccaaattgcacattctcttttttctagtgaaatctattgcacgcactgaggactcgttcagcaggggccgggctgccccataaataagtcgtgcctaggttgatctgtgtggctgtcactgtatatataatagaagagacagtgtcagggagcagccaacattcacctccttgagcacatgtttccaaattgcccttgacaggttatgagcagagcatttcaaagggatgcattaaatacagcacaagtgctttgagaatctgcctttctacatcctgaggctggcactttgatttcttccaattccgtttggtttcccacttcctacgagaaggaaggaagctgagagcaactcctggggcagctggtctggctgcagggttactcccctggcttgtgaatattagaacaaaactatgagttgatgaggtacatggtatctgaggctaataaatatgggttgaaatcctggctctacaatttactagccacatggccctcagaaagttctttagcctctcactttttcaactatagaatagaaataatagccctctcctccagaaggttacagtaaggataaaataagcatgttaataacagctaatatttattcagtattcattatgtatcaaacacttcactaagcattgaacatgtgtggattacttatataattctcatacagaaataggcaaaattgttatctcaatgtcacagatggggaaacggaggcaccgagagtttctctaactgccccattgtctcatagcaagctttgcaccaggctttctggctgcagactaaaactgcttagtgaccactctgcgagcagagagtgcctggcacatagaaggtgctcaataaattttagggtttttttgtttgtttgtttgttatttttgtcattgagttacctcgtaattgctcacctattcagaaagaacaagtgtcagtgtcttggggaagaataacagaattatcatttactgaacctcagatgtgtgccaaatgctttacttgtattttcttatttaatcctcacagcaaaactgcatgctggtcctattattcccattgcctggatggggaagctgagacactagaaggccaaggactctcccaaggcaaataggagagccaggattaaagtcccagtccatccaacttcaaagttcacaccacactgacaacctaaacaaaccctcgatgcttatatcatctaaatcaaacaaaccatttctgcctccccactttcatcatcgtcatgtaagtcacagattcttaaagtttactgtgcacacagatcatccgggcatcctgttaaatgcaggttctcattcagcaggtctgggagggagctaagattctgcatttctaagaagcacccaggtagacaacacttagaatagcgaggatgtaagagagtccttcaaccctttccatgttttctcactctttgccacttaagactcaagaggcttctgaggttggagactgagagaggaaattagttccaccttcttcagctctatggagtcagattttccaaagcacccctttccccaccaaaaccatcctcaccaccaatgtcaccatcacacacgcacacatacacacacaggccctctcaacctctcttgaatttttatgtctttttgacatgtggttgttgggcacatttcatattaaatcactccaatgtcaaaagaaaattcaaattgttactaagcatatttaactccaaagaagaattctaccataaggctaaatgcagcaataccagcaatttacaactgaatagtgccttaagtaatgataatgagcctgatgacatttggttgtacatggttaaatctttcgtaaaatagtccctctccactctcaaatttaaacctagtgaagtatttaaaaggttcttcataaagcactctctcttgccagcccacagttttatagctgtggttctttcctgtccagcctcatctcctgattctttcccacaataccctgttttcccagttgtgctggacttgcagatctttgatccccatgatcattcctactcagggccttggaccatgttctttcctcttcctgggctctcttctcccatctgtaattccctgcagatctctgtctcccaacccagagtttccttccatagagaaggttttgaagtcaagatacactcaaggactctgctcaccactccaagatattgacttcatatcccttcatatcctactctctatagtacatcaatccctgggtagaataaatgtaataacagtctctgccagaaggttacagtgaagatgttagtcatagatcacgtttgttcagtactcattatgcacccaacacttcactaagcactgcatgtctgtatcacgcatataattctcacaaattataggagaatacatcattctcatataataacccacatgtgtaacatgatcccatatagtatatgtaatatatgtatgtaatatacgtacatatgtatatccatccatatacatatacacacatgtgtatatgtttacatgcacacacatgtatatacatatacgtatgcacatgtacgtgtacacacgtgtatatgtgcacatatgtacatatgaatacatatgtataaatgtgtgtacatgtacatatgtaagtatacatgtataaatgtatacatgcacattttatctatatatgtagacatgtatgtctacatgtacatgtcgacatatatacatatgtacttgtattccatatatgtatacgcatatatgtatgtaatatatgtagtatatgtataatatatgtatatatgtaatatacatgtataatatataaccccatgtatgtataataacataatctcgtataataaccctaagtcacagatgaggaaactgaggcatagagaggttaaacaactggcccattgtctcctagcaggctttgcagagagagggcggtggagaagttaggagggacccatttgagcatatgtttcagaagtgcaagaaacaccagttgatgtggtccttcagggagacttgccagcaggagagaaaactagaatgaagagcagaataatacagtgagaagggaagaaggaaaatgagggaatccctgaccttaacaccaagcctgctattctccccagatcttcccacctactccttccatcactcatgatggaagtcctttggatgataaaatcacagagtaccaaagtggctcatctgacagatgaagaaatgaaggaccagagaggacgggtaacacagccagatggctgtgtgtttggccgcccctgcctttttatctgactgtaccatccagagaacactctgaaggactgtgaggcagagaaacaccacaaattctgccacagagcctcaattcactccaatccctttaataggtcttgttcagacaaccttgtaaagctacagaatatggtttctctttctttgatactggaagtgtcaggagtctctctggccatttatttgatgtagaggttgctaaatgttatggcaaatagccatatcaatctggttaatggctgagcattggtgttggctgaaaccttaagacctcaccaatgagaaaggaaaggtttcctggtctccagaccatgctgtacatgaatatctggaacaggaaagtcatgtggtgtgatggactctgtccctggagctaaggagtgttctatcttagccttgattctgttgctaacttgtgtggccttgaggaaatcagctactctctctgggaagctttcacaaaaaggaaaaagaggctaatataaatagcccagaacttgtgcatacagactttagaagcaaatgtaccctttcagaatttgctgatgcccatgaattccttctctcctctctcagtttactgtggctacagctctcatgcttactgctgtgtaacaaccgcaaaatcccagtgggtgcaacaagaagaatttttgtagctcacgcatctgcagttgcgctgatgcaggctcagctggcctggctgattctgtctaggcttggctgcagtggctgcctctgcttcatatgtgtctcattctcttccagctctgaaagatgatcccaggtagatgtatctcgtgataatgacagtgacacagtgacacagagcaggcagaaacatgtgaggccccttaagtcttagctcagaactggaacgctgtaactctcaccttattctactagccaaagcattacacacagccaagcccaaagtgaaaggtcggggaaatatattatactccagtattttggcacaaggagctataaagtcatgtgggatggggcatgcacagagccaatgaattaatccacctgcgctctttaacaggaaacatgggtctccactgggccagtttcctccctgttctgcactatgtttttcttacgttgtgcctccagttccccacctggaatcactcccccatccacctatctaaactctgtttattccacaagacccaggccaacagccccctcaaccgtgaaagcttctccagacccacagttggccacctgaactgttccaatcctctggcttgtgggtaggtgtctcctacctctctggccaactagcagctgacttgtagaagaccataagtaataagtcccatcaagtggtgctcactggtgggttaggatgcccgtgaagggggtgtggcattggtgattaggtttcctaagaagggagggaaacattgactatctcttctgtaactgccctgcccttagggagctgaatgatggcatttccccttctgggttcactgagtcagaaccacccctttgtccactggtcagggtgctgcactttgtcacactggccccggggcagccctacttgcccccttcagcttgtacatgcccccttcagcttgtacgaagacccttgattctccctagagcccacacctagcccatgtaccagggcagaaaagcagacatcatagtgaaagaggagagttcccttatccctctcacaaggcatgcagcaggggtgcggctcgctccttcggttgctcagctgctcaaacccctaggggtaccaggcagacaggcaggtgcagaggccatagggagcgcttttgggtgatcttctttactcagccttcagattctaatactaatctctttgtgaacgcccttagagacacagccagaaataacattttaccagctatcttggtaccccttagcccagggatgtgataaatcaatcccataaattaatttatatgtccatgtattaagttgacacacattacagctggctttagggttattaggagtcaagaataaaatacatgtcaagggacccattttctgccattgtgcccaatggatgagctttctttctacaccccactgcatctcccttagcctcctggattttcaaggtctcactgacctctggctacaggactaggcctggtgggtgacaaaataaacacagtcagaacctatgtgggaaggaacccacgtaggttccttcccatcctccagggccaatctctcaaagtccagtcctaaccatttttttttcccaaagtcagaagcagccccgcccagcctcctgcatgctgggctatagatcctttcctcctcttcatgttaagtgcccaggacaattttgcacacacttctcagcggcggctgcagcagagactgtaaacctgtacgcagaattcattagctctgccgcaggtcctggtgctcaccttcctcagcactcttgtttctaagaggcatctgtgggttctggctgagtaaaaagaggagtccagcatcccctgatattcagccatggctccagtggccacctggagcacatcaaagtgggctcctgactttgcaggcacgaactagagcctggcagatgcatttgaggtctggccgtgccacctctgctcagagtacaatttaacagatttttttccatactgctctgggaagtggggacctatagagatttggtaattggcatcctaagtcctagcatgctttgatctctgcagcaccttgctgctctaattgcttagagacccattttcctatcccaagaccacaggccagagactctgcaataacctgaaggcaagagatattaaactgtctcattgcctctgctctgaagagaaagaagttttcaatttcagtcgtagtggcagggcaggacaattctagggatacctaggatctaagaagtttcttccataagtcagggctggcccatgaggacaagggattcaacagggttaccccccatgtggaatgggctggcttgggaggttgtgcaaattaacgggatgcaaactgatcatccgtcaagccagaaacctgggcattatccacagttctctttctttcctacacaccccatcaatcagcaagtcctggcaatgttacctgctaagtacctcttgaatctgttgcaccctctcctcattcccatgaccacagcttccgtccatctcttacccattttctgaacgcctctttccagtttgagcctccagccctctaaaccagggatcagcaagtacagcccatggaaggatgggaccaaatctggcctatcatctgcttgtcttgtaaataaagtttattggaatgcaaccatgccatttgtttgcatattgtctacagcagttttatgccacaacagcagaactgagtagctgcaaaagagatgaagctcatggagcccgtgaagtcaaaaaatgtgtctactctctggccctttaagaaaatgttcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggggtggtggcgggcgcctgtagtcccagctactcgggaggctgaggcaggagaatggcgtgaacccgggaagcggagcttgtagtgagccgagattgtgccactgcagtccgcagtccggcctgggcgacagagcgagactccgtctcaaaaaaaaaaaaaaaaaaaaaaaaaaaaagaaaatgttcgctgtctcctgctctaaaccaccaccagttaagttcatgtctttttctctccttcaaaattcatcaaccattcttcctgccaactaataaaatttgaaattccttgccacacatgcctcattctttatgaatgggttcttagctagttcaggaattataacttagcaggcaacagactttatctacttcgtatatttctattgtggcctaaattgaatttgaaatattaaattagtggccaactttttatagaatgataagactatatataaaaattcatatttatgacttatcttgaggaataggaaattctggcaacacctggcccttcattgacaatgagcagccacaatcaatgcacatccaccctctttaggtaaagccacagactccacctctcccctattgtcctacacctgtcctgcttcattcgtacaagcatgagtttgaaaagccctgctcttccttctttctctgccaatcggccctcttcctagaacagttttcctatagctatactgcaagacagagtccccaaagaagccgcgctccatcccacctccacattttcatgcacgctaccttcttacattagtttgctggggctgctatcacaagcaccaaagacttggtggcttaaacaacagaaatgtattttctcacagttctggaggctggaagtccaagattaaggtgacagtagggttgtctcttctgaggcctgtctcctgggcttgtagatggccgtcttctccttgtgtcttcatgtgcccttccctctgcgtgtgtgtgtgtgtgtgtgtgtgtgtgtgtgtgtctaatctccccttcttacaaggacaccaatcctatgcaattagggtccaccccaatgacctcattcaactctaataagctcttcaaggacctatctccaaagacagtcacaatcttaaatactggaggttagagttagaacttcagtatttggtgggaaggcacaattcagctcttaacatcccccttccatgagtgcctttccctactgtatttacctaaaaaatatgcattgttactccaggaatcagaccatgcacaacctcctccaacagcccctgcagggttggttttctatcatatgtttctttgcaacttacatacacctttactagagaactattatcttgcacttcaatgatttctattccccctttcttccactaaactgtcagcttctaggtggcagtaactatatttttttcatccctgtttattcaataaatatctactgggggcctaccatgtgccatgcactgctaaagccactgaagattcagcaacgaacaagacgggcaaggtccttgactatatgggctcatattctagtaagggaaaggaatggtaaataagtcaaaaagcaatcgtgataaattgcaaacactgtgcttaatccattgtaggtgttcaaaaagccttaaactgaatgccatggggagaatgcgttcatctgggaagaatgggagaagaggggtctaaaaccctgagaacattttcaaacctgaaattttgtgattttttctttactctgagttgctgagggagttattatgcagaaggtcaaagaaggctcccattgtcctgaaagctcatgtcacttaatgatgcagaaacttgggtcactgcatcccttcacctgtccttaaatcatgagacctcacagcatccctgagaagagacgtgacaaccaagacaaagcccaccaaatgtctcccatcccacggtctcaaaattcccacagccaggggtctgtttgccagtggacagacctagagatgaggtatattttcctgcattcaatttttggataaatttacggggcagtggagaatggggtaagggcgggtgattaggcctcgggactcgcactgtgtaaatgatgcccatttcaggtgcatcacagcccatatcagcctttaaggaagagaaggaccatttctagaaattctctagtaataaggcatggtatcagcatactgggactcgtgctctgctaaaagcacaaagcctgcgggagctcagcatggccacagtaatgtccattcccttcctatctgttgtccataatttttaaaaaaataaatgctatttgggtaccaatgtataaagttcatattgtagaatgtattaaatggattaaaatgcagaaacaaaattcatccgtggaactctgtgtcctcacatatttattcatacaaaatttagaatcatttttgtcacattaaaaatttacattacgtttgtaacaatgtcaaatttatagattaatctagtgggaggtggcttaggaatcccaagcatatcattctaaaatacatcaagtggtcttttaaaacactcagtacactttataaatatattccattatgtcctgcatatcaattatcttctgctaggtggtttctattacttggtaactacactcaatgaaatctttttaaatgataatattttctacctgattattgttggttaaaaaaaaaaggaaaaattcagccaaacgactaaaccctcttattacttctataagtttttagttgattccatgagattttctacatagatattcttatcattttaagtaacgattatttttccatgttgattccaagacttattcctagttcattttcttcgataattgccttggtgagcaattataaataaacaatgactgagagagcagtttgttcccacattcgatagaaatgtgtttagtggggctgggcgcagtggctcatacctgtaatcccagcactttgggaggctgaggtgggtggatcatctgaggtcaggagtttgagaccagcctgaccaacatggtgaaaccctgtctctactaaaaagacaaaaaatagccaggtgtagtggcacatgcctgtagtcctagctactcagaatgctgaggcaggagaatcgcttgaacccaggaggcagaggctgcagtgagacgacattgcactccagcctgggcaacaagagtgaaactctgtctcaaaagaaattctgaaaaagaaagggaaggaagggaagggaaggggaggggaggggaggggaggaagaaagaaagaaagaaaagaaagaaaagaaaagaaaagaaagaaagaaaaagcaagcaagcaagcaagcaagcaaagagaaagaaagaaaatgcctttagagtctccctgtattaacaggcataacattggttggctcttcgtttggtttagataatattttggttatgtttttaaaaatgcattttcagattcaagcctttattatcagtgagagatgtcagattttatcaaatattttcgattttatcagtatttaagatctgagatgatcttaagatttatataatactttcttctatgctacagattttcataatcctttattttccaagatgttacaggaccaatggtggagttatttgatcaaagatatgcacattggaaagtctttatgtgttttgttaaaccgcatccccaaaagattaggtcaattgacacctcgcccccagcagtggatgaaaatgcctgttatactgaactctcactagcaatgtgtttttaacaaccaaaatctctcttaatttataagactattgaatgttagatacaaaatacacaaggtatactacctctttcctatcctcttactgtacttcttaaaaagtgattgttggttctcaggtttatgttatctgctgacatttcatagagattttaacaccgttcctctggaagagctctaacggaatatctagaaacattttggggtcacataactctaatattctgaaaaagctattggattagggcccactgcaatgacctcatttaatccttcagaggtctataaggaccctgaagacagattcttagatattaggggttaggacttcaacacaggaatttgttgagtttttgtttgtttgtttttttgagacagagtatcactctgtcgccaggctggagtgctgtggcacaatctcggctcactgcaacctccacctcccaggttcaagcgatcctcctgcctcagcctcccaagtggctgggactacaggagtgcaccatcatgcccagctaattttttgtatttttagtagagacggggtttcaccatgttggtcaggatggtttcaatctcttgacctcgtcaacacaggaatttattttttgtttgtttgtttgtttgtttgagacagagtatcgctctgtcgccaggctggagtgcagtggcacaatcttagctcactgcaacctccacctcccaggtaaaagcaatccttctgcctcagcctcccgagtagctgggactacaggagtgcaccatcacacccaaatcttttgtatttttagtagacggggtttcaccatgttgatcaggatggtctcgatctcttgacctcgtcaacacaggaatttgaaggggagaaacacaattcagtccacaacatcccttttccaggaatgcccttcccttccttattcactgaacaaatcctcattcactcttactttaaacatcagatcgagcacagccttctctgacagccacaatttcttcccagaaaaatgtgcctacatgcaaatttttttcactagtttcagaagactcccagatctagcaggagtgtcacagacccacaaagaagaaatctgacctattttattatccctgttttacagataagaaagctaaagcccccccccaaaaaaatctgcttttcctaaaaactaaaataaaacaattttttttctcattttaaaggccttctcccacccccaaaagaaaatcgaggagaaaagcatatattgctttctacttaaaacatagatattttgattttgaaaaagaaaagtgctttgagaaacagtggcttgatctgagtgaacacagcgcgtcccaaggtgagcactttaagagggttcacgtccaatctcatggggtgaggtgggaaaagtgctgatcagggaacatgaaacccaagatctggtcctcacagacaacagactgaatgtaaatcctcgaataactcaaaagccccatgagcctcactttccacatccataaagtcgggtactaatgtttgcctcacagccacgttctaaggaataaatgaaatttctggacacataaggaaatgctatatacgtaggttgctgctatatattgttaaagattatttttcaaataaattcagcaaatacatatggggcacctatgatatgccaggcactgttctaggtgctagggaataaaccctagatgggagagttgggagggctgctcctctggagtttgcaatctggcaggcacagccaaccttaaagtggggatttgtattaggcccttcttgcagtgctataaagaaatgcctgaggctgggtagttaataaagagaagaagtttaattggctcatggttttgcaagctgtataggaagcatagcagcatctgtttctggagaggcatcaggaagcttccaatcatggcagaagatgaacagagagcaggcacattacatggcgagaacaggagcaagagagagagactgggacatgtagagggggagatgtcacatgcttttttatttttatttttattttttgagacagcgtcttgctctgtcgcccaggctggagtgcagtggcataatcttggctcactgcaacctccgcctcccggattcaagcgattctcctgcctcagcctcctgagtagctgggactataggtgtgtgccaccacgcctggctaattttttgtatttttagtagagacagcgtttcaccgtgttagtcaagatggtctcgatctcctgaccccgtgatctgcccacctcggcctcccaaaatgctgggattacaggcgtgagccacagtgcctggcctaaatcactagatcttgtgtgaactcagagtaagagacggctcacttatcaccaaggggatgacccaagccattcttgagggatccatgcccatgacccaatcacctcccaccaggccccacctccaacagtggggactacaattcaatttgagatttgagcagagacaagtccaaactatctcaggattcaaatgggataattgtcaggaacaaagaagtgcaagaagctgagggtgcttacagggacaggaaccaaccccactggaactggtcaagatgtcccatgtaaggagagtagagtaactgaaacctgcaggggaaggagggtttgtccagtaaaaggaagagggcattttaaggatcaggaattaagagagagctttgcatgttaaatgaacttttaaaagtccagtgtggggtgtgtgtgtgtgtgtgtatgtgcgtgtgtgtgtgagagagagagagtgttatagctgtgtgtgctgtgagtgtgtgcaggctgtaggtttatgtgtctgttaataggttgcatgtgtgtttgagggtatgtgggaggggttgtgagttgtgtgtgttgcggttgtgtttgtatgttgtgggttgtgtgtggtgtgggttatgtgcattgtaggtcacatgcatgtgggtgtgtggcttcatattctgggttatgtggtgggttttaggttgtggggagttgtgtatggagtgcggttatatgggggaggtgtgttatgcttatgctgcaggttgtatgtgtgtatgctgtaggttgcatgtatgtgagtatgagttttaggttatgtgggaggggttctgtgtgtgtatgggctgtgggttgtatggatgtgtgtgttgtgggttgcatgtatgtaattgtgtggcagattgtatgttgttagtggcattcattgggtgtgtattttgggttatgtggtggggctatagggtgtgagcagttgtgtgtatttgttgtgcatcagtgtggattatggagtttgcaagttgtgtatgtgggttgtggggtgtgagaggtgtatgtgtgtgtatgtgtgggtgataaggctaaaggggtaggctgagtcagactccacatgatatagaagacactgttggttgcccttcttcaatgaaagttgcccgacttccaaatgccagaacctgctctgctttgcctggggactttttctgggtctgggtccccccttgtccccactgtcagcagtgccagcgaattcacgctccccacccccagagtcctccaatcaatgtctgagcaggggtgggtggataaataccccagctccctcacccctcgggggagataatgctgacatgtgtgttctgtgccactcttcagctttgcctggcaggatttagctctagatgcacacagtggtcccgtgcttcatagcgaccctttattggttcttttccttcctgtttcactttcacacccctatctgggtgtttcctgagcccttcctcaaaaaaaagacctggtctcacatccgttacctcattggtctacttctaggccaacccaagctgagacagccatgtaagccatcctggacttcactctgagggcagcgggcagccatgagggttattgacaggggcatcccataatccattgttttaaaaaattaaatgaataaaacatatggttccagcacctttctatcatccacaattcgtgccttggaaaagggtgcctatagtccatgcacaaaagctccccagtcaaggaaggctatgtgcccacctgccaggccaaggtggtcccaccctccagcaggtccttgagattccagagcattcaggtgactcatctgagggcacaaagctaaggagccatcaagcccagggtgcagtcccagccacctgcacacctgcatctcagccccattctcaccaggatgcttctgcagtaaaaccttcaaagtcattttatccaaaccagttaagatcaggaccccgggccaactcaaaacctgtcagtcacaactgctgtttcgagaggacactgtcactttcacttagcctccactgggaaaatgaggaccaaagccatgtccctccctgggacgggagccaggggcctgtttcttttgcaagtcaggcagctgctcacaggcctacttgaaaggagaggatctgggcagttgtaactgtctgatcctgcctggcacagttctccaggggagcattgtccctgtcatgcgggtgaagcccaccgaggtcgtcactctctaagcatgacagacagacagtgcagctcagctggctcgtgctcctttgaaatttttctatgtcaggctcatccttcagtgtggatgagaaaggacagagctggagcctcagcagggctgggaagaggatatcagaatggtgtgcgcacacgtggaaagaaaaggaaattgactaggagatgagtggcccctggtccgatgggatggacaggaacacccccctccatgctgtgggggctgtcggtcccgccaagacacctgcttcctggcggtcccaggaggacaggcattgccagaaaaatggagtgtggtgcaaccctacatgtttttcctgtatatgcattcttaaatcacttaccctctcagtgcttcggtttcctcccttataaaatagggctaataatacctatttcaaagcattgctgggagacttaaatgagacagtgtgtataaacaccctcaggcagatgctattagatacgccttactttccccatcaaaactaacatttggagagtactcactacacaccaggtgctgtcaaaacatctttgctgttcaaccaccctgggaagcagatcctacaattcatcccattttagagatgaggaaactgagagaggttccataacattcacaagatttagcactcgcaggaagtggcaaaagttgcatccccggcagatctgactccagagcccgacctttgagcctttccaatttctcccctatttacaagggaaacagaaagcccacttttcccaggaagagcacttctgtgtcatcaggcatgggtcatgttcatcacccatgtatgatgtcttttaaggacataaagctatagtgtcattggtagtgtatttgatagctctggcttgaaaatcccataaatcaaaatcatgatgctgtacagcagtggttctcaaagcgtggtccacggacctcagcatcaacagtacctaggaaggtgtcagaaatgcaaatcccgggtcccagcccaggcctactgagtcagaaactctgggagtggagcccagagatctgtgtcttaccaagccttcctggtgacactgatggatactatagtttgagcaccaatgccatagtagagtacaaattttctttttcttttttttttttttaagacagagtttcgctcttgttgcccagaccggagtgcaatggcacgatctcagctcaccacaacctccgcctcctgggttcaagcgattctcctgcctcagcctcccaagtagctgggactacaggcgtgcgccaccaagcccggctaatttttgaatttttagtagagatggggtttcaccatcttggccaggctggtctcgaactcctgacctcatgatacacctgcctcagcctcccaaagtgctaggattacaggcatgagccaccgcgcccagcctagagtacatattttcactctccaataactacaggtcatgaaggaaattgtaaataaataaataaataataaattgttactgttttatttccaggtgggattggtaggaaataggagcagtggccatgttcattgagggttaacaagttcattcattcattcattcattcattcactcggtatttatttcttgggaactatacgccaggcactatccaggaaataataaaatgtagttaaacagacacagacgtgtgtggttcctacttttataatctaacagttcggtgaggggcaggggcagtcatgtaacaaaaatgacacaattattaaattgtgtttgtagcaagggctatgaatggggaaaggcatgaatctggaaagcagaatgggagcccccgatcaaatcttggaaaacctctcagaggaaatgacactggagtcaagatactggccagtgaagccagtcgggagttgggggaggcaatgaccgtgatgaggaaagggagcgagccctctagcagaggagacagcctgcacaaaggctcccagcgcagcaaaggcagggtgccctggggcagggaggggctctgcgggtgatctcaggtgcgcccccagtttctacgtgaatccctccacatccagctccctcaccttgtaatgggcaaagtcagaacatccacccacagggccccacgtgatttcggctgctcacagaggacacttttcccacctaaggccccagacacaagttcagcttcctcgctgcactcttaagccagcaggtggagagttttgagttcccatttccctggtggctaagttccgcgtgaagccgggagctatgcacacacaagacacgcctgggactgctgagctgaagctcctgttcattactgtagcttttcatttcctctttctttctgctgcttgaagctctgccttctttttcccaagctcagctacacttcttttacccaacacttctttgtaattaaagagaagcagtgagaattaatttgccacatcagctcacttcattgtattgatttttttaaatcccacccctcccaaaccaaatcaggtatcattgcagtgcacttctagagtatcttgtgcctcccatcaaaacctgaacacacaggatcgtaatctgtgctttaagcatctcctatctgcacccccaccccccaccccgccaagctgcaaattccacacaggtatgaactttctggcttttgctcatccatattcccagcacctaacccagtgcatggcacataataggtgctcaataaatgtttttgaatggatgaatgagttcattgttaaccttcacacaattctgtgaggtagactgccaccttgttaccctttttgaaggtgagaaaatggaggcttggcatgtttagcaactctctgaaggtcaaatatcaagttgcagatcttagattcaaaatctgggctgctacatcccaaagatcaatgtcttctccatgcatcacactgtctcttcaacaacccttaaactccagaagggcctaggtgtgtaggtgagtgcgactggacagaaaacaggaatgcttctttctgccttgagtcaagacactgtttgtatgattggaaatgaagggtgggagccttggtacatggaaggaaaattgggctggtgacagaatggggtgaatgcagacatccctgcacagtggcaacagggaggagatgctcttatcccagtaaaatttaatccctcataaaaatagcaccatatttggtagattgcatccctcctgtaatgcaaagagcagcaggattttccagatgaaaagtcagcttagactggtgcacacttgccctcagggctgatccctgaacacagagctccagagtgtgcaaagatggcctcttagggaccaaactgtcaccaggaaaatcacaagaagagaggccaacaattctctgtgactctcaatccaggagctccaacttaactatgtacgacattcaggattctgaaaccttagcaaatttgaaattatgattattacctcatcaacataacagttgagtgaagaaaagcagggtataaattgcatttcacgatgatttccaccttggttaaaagaaaaataaaaatatatgcggcatgaaaaagccccaaaattaaaggcaacacatgaaaagcttcaggagtagaactcagagtattttttctctctctctcattttctatattgccctaattttcattaatgaaactgcctctcataaataaaacaaaattccattttaaaggaatataatggtgctcagtacatgcttgttatatggccagttcattctattttacataacccgggatagtgcatattatcagcctcattttataggcgaggacattaggttcaaacagactgagtagcttgaccaagctgtagctcctaagtgcaaagccaaggtttaaaaataaattttgacctactctaaagcagcacttgccaacttggcatgttagaatcatgagaagctttttaaatcctgatgtccaggccacgccccaaaccaattgaatttgaatccttgagtgtgggactcaggcatcagtatttcttaaatgttctcagcaattataaggtgtagccaagattgagaactaatgctcacaagcctatgtcctcaaacacagtgctatattgcttctctatatacagaaatctattgtcatttgttgggaatatagataattattattgaaaaatcttaataccatcaaatattgcctaagaaccctattgatttctgagccttgtccacatgcccagatcaattcatggaaagagggtagccaccctacagaagagtagtagttcaacgatcagagcaaggaaaagaataatgatgccaagaatagatttctgaaggctgaacccattcagaaaggtttcctgagaaatccaaaatctgaacagaacaataacaagtaacaagatcaaagccttcataaaaagtcccccgctaaagaaaagcccgggtctgatggcttaactgctgaattctatcaaacatttaaagaactaatgccaatcctgatcccaaaaacagacaaagacatatcaaacaagaaaagtacaggccaatatctctgataaatattgatgcaaaaattctcaacaaaatactatcaaactaaattaaacaataccttagaaagatcatgcatcatgatcaagtgagatttatccctgggatgcaaggatggttcaacaaatgcaaatcaatcaatgtgatacatcatatcaaaagaatgaaggataaaaaccatatgatcatttcaattgatgctgaaaagcatttgataaaactcaacatccttcataattaaaaaccttcaaaaaactgggtatagaagaaatatatctcaacataataaaagctatatatgacagacccacagctagtatcatactgaacgtggaaaaacataaagccttttctataagatctggagcatgacaaggatgtctactttcaccactattatttaatacagtactggaagtcctagctagagcaatcagacaagggaaggatataaaggacattcaaagtggaaaggaagaagtcaaactatccttgtttgcagatgatatgatcttatatttgaaaaaaactcaagactctacaaaaaatctatcagaactgatagattaacaaattcagtaacattgcaggatccaaaatcaacaaacaaaaatcagtagcatttctatatgccaatagggaacaatgtaaacaataaatttaaaaaagtaatcccatttacaatagatacacataaaattaaataccgggaattgacttaaccaaagaagtgaaagatatctctaataaaaactataaaacactgatgaaagaaattgtagagtacaccaaaaaatgaaaacatatcccatgttcatggattggaagaattaatgttgctaacatatttatactacccaaagcaatctacagattcaacgcaatctttttcagagtaccaacaatattcttcagaaaaatagaaaaagctatgctaaaatttatatagaaccacaaaagacccagaatagccaaagttatcctaagcaaaaagaaacaaacaaacaacaacaacaataacaaaaacaactggggaaatcacattatccgacttcaaattttactacagagctacagtaaccaaaataatatggtactggcacaaaaacagacacatagaccaatggaacagaatagagagcccagaaacaaattcacacctacaatgaactgattttttacacaggtgtcaataacgtacaccggcgaaaagacagtctcttcaataaacagtgctgggaaaactggatatccatatgcaggggaatgaaactagatccctatctcttgccacatacaaaaatcaaatcaaaatggattaaagatttaaatctaagacctcaaactatgaaactactacaagaaaactttgggaaaaatcttcaggacattggtctgggaaaaaatttctcaagaaataccccacaagcacaggcaaccaaagcaaaaacagacaaatggaaccacatcaagttaaaaagcttctgcacagcaaaggatacaatcaacaaagtgaaagacaactcacagaatgggaaaaatatttgcaaactacccatctgacaagggattagtaaccagaatatataaggagctcaaacaactctacaggaaaaaaatctagtaatctgattcaaaaaaatgagcaaaagatttgaatacttgtttcccgaaagaagacctgaaaatggcaaacaggcatatgaaaacgtgctcagtatcattaatcatcagagaaatgaaaatcaaaattacaatgacttattatcttatcccaatcaaaatgacttatatccacaagacaggtaataacaaatgctggtgaggatgtggagaaaagagaaccattgtactacactgtttgtgggaatgtaaatttgtacaagcactatggagaacagcttggaggtctctcaaaaaactaaaaattgggctaccatatgatctagcaatcccactactgggtatatacccaaaagaaaggaaatcagtatatcaaagagatatctgcaacaaaaaaactcctgtgtttgttgcagcactgtttacaatagccagatttggaagcaacctgagggtctgtcagcagataactggatacagaaaatgtggtacatatacacaatggagtactatgccaccataaaaaagaatgagatccagtcatttgctacaacatggatggaaccgaagatcattacattaagtgaaataaaccaggcacagaaagacaaacatcacatgttctcatttatttgtgggatctaaaaattaaaacaattgaacgcatggacatagagagtagaagcatagttatcagaggctgggaagggtatcgagggtctggggggaagtggggatggttaatgggcacaaaaagaaataaccagaaagaatgaacaagacctactatttgataacacaatagggtgactatagtcaacaataacttaattgtacattataaaataacttaaagagtataattggattgtttgtaactcaaaggataagtgcttgaggggatacataccccattctccatgaggtgcttatttcacattgcatgcctgcatcaaaacatctcatgtactccataaatatatatacacccactatgtgttcacaataattaaaaattttaaaaatttaagaaaataaatagaaaggttttctggttgaccagttcctacaaagacaggaagaacttaagataagtaaaaaggagagaaagtgactgtggagaagtttcaataaaccaagtccagagtgaattcaaatcaactgcacccactggtgatagggtaccaggaagcagcagaggatgactgcttatttacacaactcaacaagaaggctcagaagaagaaactgagatccctggaaggacaagaggaacagatctgagactggttcacagggaagaggttgaagctaatgcatacatggatcaagatagaggttagagcaccaggtttgggaagaacaaagactaagctagctcaaatgatgactcccagcattaaggtaaacagaaaacatttctagaacccttgctatacatgagtaatttagattattgttcctctctccttcttactgtaggcaaggtatacttcctagtcccatcaatccgagttttggccgtgtgacttgctttggccagtgggataaaagcaaatgttgttgtgaatgaaagtttgacatgtgcttgtttgcttgggcttgccctcttgagcttcttccttttgctctataaagaataagtgttgggtagtggctggtccaagaaacaggagagatatgtagaacaagccttcaccaatccacagggttagaggcaagcccagcctaggtcagccaaactatagccaacctgccaatacatgcacaggaaatagacagttattgtggtatgccactgaaattctgaggatgttcattacatggtgctattgcagcaagagctgactgagacatgtgattctctccttgcatccacaccacagtccaggtaagtaagcactgtcactatttccattttatagaggaggaaacagtcttggggaagttaaataacttgcccaagagtggtaagtggcacacctgggtttctaactcagatcttcctttaaagcccaagcttaaaaccactaccctatgccacctccctgaaactttattatcaagagggctgaggactgcaacggcagagacttttccagggcttttatcagataccaagtcatagtgagagcaggtggaatttaagagccagagaacagaggacaccaagtggtcacagtgacattgctctgaaaacttttctctccatgaaatggcacagggacactggggttatgtttccaatggtcaagatttaaagggactggcacctccaaagctcttacaagcctttctgtcttaacgggagcataacacctccggagagaatgatgctgtgaggtctcagcaaaattgagcaccccgtaatacagggtttctcagccttcactctattgatatgtggagttgaataattctgtgttttggcagtatgtctctgtgcactgtaggatgtctaagagtatctctgggccgggcgcggtggcttacgcctataatctgagcactttgggaggccaaggtgggtggatcacgaggtcaggagttcgagaccagcctggtcaatagggcaaaaccctgtctctactaaaaatacaaaaattagctgggcgtggtggtgcgcccctgtagtcccaactgcttgggaggctgaggcaggagaattacttgaacccaggaggcagaggttgcagtgagccgagatcgtgccactgtactccagcaagtgtccccctaaggaggggggtgtaaattgtccccagttgagaactacagccttaatacatgaagcatatttaagaaaagtgtcactgagaatatcatgcaatgtcttgactcctaagcctggctacacattagaatggttggaagggttttgggaaatgcaaatccccagaccttgattggactcactgaatcagaatctctggaggagaggcctgggaccctgtgttttttaataaacttcccaggtggttctcttttaggcagcccagcctcagaccagggtctattatttgcaagtcatggtatagtcattataagcatggtccctggagccagagtagcccaggcctggaggccagcttgagcatttattaacactatggaaaaaatgtcatgtttcccagctgcatggcacttcttggacaatagctttcctatgtcaggggcatttcccactgatgagtcctgcctccccaaaagggcagccccaaaactcgctcatgtaattctctgagaatcagatgtgcttatgtgaaatatcaattcagaagcccaacatgtgaggaagatggcaccatgtagtgcccatctgtctggcaatggtggcaatggaggcaggtggctctcagggcatcagaactgtgtttagagtcagtaacaagagcttggtgcccctgcccagaggcggcaagagtgggatctgcaaagaccagccctgcagtggggtttctggcaaggccaacctttagccctttgagagagtctgcacgttccctggtagcactgaataaatttctttctgtttaaactagcttgagtgggttctgttgtctgcaaccaagaagagcgaactaacttcatccctgagtcttttttcctcatctggaaaatgcgaagcaatattaggaatataacatagcttggagggtaacattggtctgagtaggttcaaattccacttctggcattacactgttgcttgaggcaagttacatcagctttctaaaactcagtttccacaaagtacaatgaagacaccacaaactttatgaagtgtcttcaggatcaaaatggagagttgaaatggtgctttgcacatttcaagcccttgaatattaggtattgttactgttggagtagcgttgaaggctttttaccatctatacaccactaaaaaccttcgctccaggaaatccaatctccttcttgattttcagaagtcaagccattccctgaccactatgcgctttgcccttgcaggtctcttgcctgaaatgtcctccattttacttccacctatccatatctttcaacacctagctcacctctctccttcgagaaatccatgctatcacttcccctctttgaacctgcgcagcatctggcaatcccatagctcaccatagatttagtacttaattatgtattgcagtatttcacccgtatttcatcctgggtacgtcttgtctccatggctagactgcagacttctcaaaggcagattccttgcttcttatcctttgggcacccacactgtgttgggcacttaggaagaaagaaaagaaaagcatgtcatattgaactgaacagctgaacagatgccaaatcaatatctcaggtcacaggagcaggggcgggtcagcgatgaagctaggagtgggtctccctggacccctggttttcatgcagcggaatgactactcggctatttggaaatttgcatacagatgacattctagaaaatgcaggtgcctgccttttcaccacaaaggccaattaagtgctcttacattttaaaaggcagactgtttgagaaatgcctctgagaacaattaagagtacaaaacgtggtaaatgaaactggaagttatcaaaagctattgaaggcagctgagagaaatggcaacttacctccacatgggaggctatacagcccagtggatcagaaaccaacggccaccagcgcccagtccctacccagcctctctccatcgtgcatgcggcacgacttctccaaacaaaagcattctcaactgtgaagtagcgataataatagtacttgcctcatagggtagttgttaagattgaatgtattaatacatggaaagtaattaaaacagtgcctagcacttaagtgctgaatgactgttggttgctatgataatgattattaatagagtattacatatgttccaaaatagcggggacctttgctgccttgttttctcagcacccggcatctccagcacacaggaaggactcaatcaatgtttgttgaatgattgcattaaatggcaagcttagctggtgacaaattatgatccagatcagcttgcagacccactgcccaagtgccctaggctgctctttccttcccacaggcagaggctcaggagcccttttataagtttctttcaatcctcagccagcccctcccagctcatcctctcagtccctcctggccaagggtccatcccccaacatcagctctagttccagcatcttgtccagctccctttgaacttgatgctttgagccattcctacaatgcctgcttctaccttctgaaactgaatttttctttctttggcatttgatagctgctagtcatcccaccctactgactgggcctgcctagaaccccaatcctgatgctccccagtctcccatggtctggggttcaaacacctctgcatcccaagccctcccaggctccacactgggactctggaattttaaaaacttgggtttaaatcctgatattcagggtatttacttaatctcgctgacctcagttttttcacctgaaaagtgggataacaatacccactcattggcataagaattaaatgcctatagcatgcctaccacagagtcttccatcaaaggggatgatccaatgctaattccttctccagctgctacttctacaatatggcagactctctagagccccataaaaacacgggatgagccatttggccagcaaggacctggtgattgaaagtgtgagcatcaagtctatttctccaaaagagagcagaactttgtaataaaactgagttgtggtagaaagcaaggaaaagccgcttgctgcagccttaatgagcaagataaagggcacatctttggaggccaggggacaggtttattaataggattaaagccaggggtagctgctggagagtcagagtggcttatcagtgtgaaatagtgtatactcacagataagatcacccccagagcagccaagaggccacttcagaaacaaacaaacaaacaaaatgcagtgggatcctgcgatagggtaggaaaatcagtggtcctcaagttctgtaccataatcttctgtaagggtggttacatcagaatcactggccgggggtgaaggattgggggttaaaatagagaatctagaacccatccctagagtttatagtccagtaagtctaaggtgttgcctgggaatccattagcaagtttttttttaagacagtgtctcgctctgtcatccaggctgtagtgcaatggcacaatcatagctcactgcagccttgacctcccgggctcaagccatcctcctgctttagtctcccaagtatctgggactacaggcatgccaccacgactagctaattttttttaagtagagatagggtcttgctatgtggtccaggcaggtctcaaactcctgggctcaagcaatcctctcaccttggcctcccaaaatgctgggatcactggcatgaaccaccacacctggcccattagctttttttctcttttcttttctaaatcttagatgatgttgctgaagaagcagccaggttttggactgtttgaagattataattagttttgtagcaattcagatatctggatgcatacattcatttgtttaacaagtatctgttatgtatttatgacatttttggtgagcaagaaataagaagaaaagatggtcatgttcctcgtcaagtttccagttggctactggagagatcagtcaaagggtacaacaatcaatcattcgttcattcaaaacttaagagcctcctatatgccaggttctgtgctatggaagcaggattttgattaggcctttaaaaatgggaagcaacaagaaaagggagaaagtcttatctttgatttcagcctaaccaagggaggcatcactgtttccttcttcttttttctttttcagaacgacatcctatattactccctgacaggggtgaggagtgtttcctacagttcacaggaaacattatgcatccatgattccagtccctaggcttggaagagaggtctgcataattgagatatagcttggtatgttctccagtgatactgagaaaagagtgaggagagtcaaaaggaaaaaataataatagcagcagttgtaaaacctaacacattaaacacttactatgtgccgagcactgatctcagtgctgaataagaataaataaacaagtaactgagttctcttactagaaaataattgtaaagtaacgtacaagtttgatattttctacacatggagttttaaatatgaagcagatatgaaggtattagtaaatagatcaaattatttaaagcaacatgtttaaactttcaaataaaacttaaacagaatcagtagtattcaatcagttctaagttattaatactaagttactcagtcactccattaagattcaacaaaatggttttgttaatcagtggtaccaaaaattaaattttggttttaaccttagtccttgttgttagctctcctggaatttttctgaaatttcatgaaaagaataaaagaatgatttcagaaaaaataaaaaataaaaataaacaaacagagccctttcattttctcctggaggaagtagcaaaaacagcagccctaaggagagataatttcagaacggtatcaatggcctccaaaatatccctgccatttgactatctttgttttcagagaatcctttggaactagcaccaaagcttcatgcaaaaagctgtgcagcactggttacaatgacctaaaacctggaagcaaactgtgttccaatagtaggggctggcttaaataatctctcgtacatacatataaaagaagaatgaggacactctctactgacatagaaccatttccaagattaaccgttaagtgaataatgcaaggtacaattttgaaatacacattattattaactatagtcaccatagtgtgcaatagatcactaaaacttattccttctgtaccctttggccaacatctttctttccccatctaccacatcctcaccctctgatcaccaccactgctaaaagtagattttaaatgttctcaccacaaagaaatgttaagtatgtgaggggaggagtatgttaattgacctgatttaattattccacaatgtatgcacatatcataacatcccattgtaccccataaatatatgtacttatttgctgattgaaaatgtttttaaatgtaagatgcagaagaatgtgtgctatcttttaaattttatggcatatggatgtattaactttttaaaaatttaaaagcaatatgtcaaactatttatagagtagaatccaatgatctatgtgggaataagaaagtttgggaaagaatttttgggaaatgttcactagttttgtttgggtagaagatcactgggtaattctttcctcccatttttctctatttctaaatttagatgtgtggtacaatgaaatacttttatcatgaaaaaaagacattttaaaatgaaagaaatcctggatccaggctaggggtttgcttagatatttaaaatcctagaacgcatataaaaagggactcgtgatcacaaaaggacatcagagaatgacaaaaatgtcaaagatgtggtcaggaaggcataaaccctacactaatttgccaaaacccaaaaagccaatgggctctcaaaatcaagccttaaagcaactttcagaggtttgctgttttaagtgtttggttaggactttgctgcaattaacaagaacctcaaatcaaactgggttaagcaaaagaaggaatttattggcttaaataatcaaaaagttcaggggaaagaaaagactgactttagaatagcttggtcctgttcactcatatttgttcttttctttttttttttcttagagatggggtcttgctctgtcacccagactggggtccagaggcatgatcatagctcactgcagccttgaaccctgggctgcagcaatctttttaccccagccttccaagtagctgggactacagacatgtgctaccatgcccagctaatttttttttttttttttttttttttttttttttttttttttttttggtctacagacagggtctcaccatatcgcccaggctggtcttgaactcctagcctcaagcaatactcccatgtcagcctcccaaagtgttgtgattagaggcatgagccaatgggcctagcctcacttacatcttgacttttttcctcttgactcagctctctacctggggcaccatattggggcattctaaatatcaggccctaggtagtggctcctagaaggccatgttcactgtagcttttttttttttaagcagttctagaagaaaagagccaaaggtgcctcttccccagcagaggcaacagtatgcattgcataccaactgagtcacctgctcatttctgcaacaatccctagagacctgagaatgcaatgccctgagtggcggggtggaaccaacaccatcagaagcgcactattctagaggaaaagcaggtaccaggaaaacagactgagcattcagcagcaaaacagcaggcagcagagaaaattgcaaattcatgtgtgcccatctcttcaagtaaaatgaataaataagcaaaatgaaaaaatatatatgtatatcattaagaagaacatgaaatctgaaatagatggacagcaagtaagagaacattgctttaaatgaattcaaatttctaggccacgtgcacaagtctcagaacccatgttcatatccatggagctacctccaaagacctgaactgtgatccctttcagagaaaccaaaccggagagaggccgctggggtctctcttttcacaaaggggatgggttggaagttgacatccgagaaccagatacaggcattgacttctgaggaaatttttttattaatcagttttataattgacaaataaaaattgtgtatattgtatttattgcgtgcaacatattttgaaatatatatacattttaaaatgccaaatcaagctaattaacatgcatgacctcacacattactctcttagcaaatttcaagaatacattgttgttaactatagtcaccatgttgaaccacagatctcttgaactgattatctgaggaaattactgaacaaattctaaaatagcagatttatgaaggcttagagaagactgatcaataaaacctactgtaaacttaccaagatcgtgtggtaccaaaacacactccacaggattacgagattgggagctctagggaagcccgataaaacccaattttaaaatagcacaaaaaataactaactattgggtactaagcttagtatatggatgatgggatcagcagagccccaaacctcaacatcagagaatacacctaggtaacaaatctgcacatataccccccgaatctaaaaatatttttaaggaaaaaaatatttaaacaatctgttggccaggtgagatggctcatgcctataatctcagcacttcagaaggctgaggtgggaagatcgctggagaccaggaattcaataccagcctgggcaacatagtgagactttgtctctatgaaaaatacaaaaattagccagatacagtggtgtacacctgtagtcccagctactcaggaggctgaagcaggaggatcgtttcagcccaggaggtcacggctacagtgagccatgatcccaccactgcactccagcctgagtgagaccttgtcacttaaagaagaagaaaaaaaagcatatgctattttcagaaacgcatttgaaaatttgaaaacatccatgtttgtgttctgaggataaagacaggtagaagaaacatgggtgtgaattagtagctcattgtctatccataccaactaaatgccatcatcatcatcatcaccataggtatttgaaggtttttactaccttacttagtcctctaaggctgaagtgctagcaggtagatatttattagtccccttttagagattaaagcactgatctcaagaggtgaaataacttgtccagctagcaaataatggagctggcatcctgacccagatctgtccagctgcaaaaatctttcctctcatgagttgttagcattattccaaacaaaacactgccctaaaagtgtgaaaatgtcctcagttcaccccttctctgcagtgggaccctgacatttaaaggcacaccaagaggagacagtgctccctgcagggctggagggtaatatctgaggtctgggagggacaaaattcacaaccaagggttactccctcccacctgtgcctgacatttttctttctaaaaaatctgctcatttctgttcttctttcctcttcatcttccccctctcccttttcaatattttatttctttatcttatttggtgttttcattgccaaagtaattcatgcttactataaaagcatcaagcaatagacaagtgtataataaaaagcaagaggtccaacccccaggaaactgctggggacagtttggtacctatccttccacagtgtttactgtgcgcacatcagtaaatcagacttaatacaatgttacaagttatatagaagtgctgaaatatacacctaagaagccagcagccttggctatagtctctggtgcatgcatgtggcatgattgtgcatggttctcagaaaccttgttgctgctcctatcattccttcctctaccagtccacaaatgtctaactgcctaccatgtgcgaggtgccaagctccgtgctcagaacacagctgtgaaccaggtggacatggtgcccttcctagaaacaaaatctaggctgcaagaatggtggctttaactcacttcaagaaacgcattcaccaagcaccttctctgtgccagcttttgcaggggatgaggtgatgtcacagatatatcagacacagcactgctctgaaatgctcatggaataatagaggagacaggctagaaaatgaggtccattatttgtgttttaaaattaggccaggcgcactgttcacaatagcaaagacttggaaccaacccaatacccatcaatgacagactggataaagaaaatgtggcacatatacaccacggaatactatgtagccataaaaaaggattagttcatgtcctttgcagggacatggatgaagctggaaactatcattctcagcaaactatcacaaggacagaaaactagacattgcatattttcactcataattgggaattgaacaataagaacacatggacacagggaggggaacatcacatactggggcctgtcagggggtggggggctaggggagggatagcattatgagaaatacctaatgtagatgatgggttgatgggtgcagcaaaccaccatggcacgtgtacacctatgttacaaacctgcacattctgcacatgtaccccagaacttaaagtataattttaaaaataaataaataaggccgggcgtggtggctcaagcctttaatcccagcactttgggaggctgaggtgggcggatcaagaccagcctgaccaacatggagaaatcccatctctactaaaaatacaaaaaattagccggatgtggtggcacatgcctgtaatcccagctactcgggaggctgaggcaggagaatttcttgaacccaggaggcggaggttgtgatgagttgagatgacaccattgcactccagcctgggcaacaaaagcaaaactctgcctcaaaaaaaaaattaaattaaaaaaactaataaaataaaataaaataaaataaaataaataaataataaaataaaatcaggccagctgcagtggcacactcacgtctttaatccctttgcactgtaacccctaagtactttggtaagccaaggcaggaggaccacatgaggtcagaagttcaagaccagcctcggcaacatagaagtttaatttaaaaaaaaattaaatttaaaaatagccaggtacagtggtgcacacctgtagccccagctactcagggctgacgcaggaggatcacttgagcccaggagtttgaggctgcagtgactgattgtcatgccagtgcactccaacctgggtgacacagcgagatcctgtctctaagtaataatgatgatgataaattaaaaaataataatttttattatgttgttgttactaacaaaatttattgaccccttcctagatgtcatacactatactaagtactttacaagcattaagtaatttcatccttttaaggaccgtttgaggtaactgtgatgattattcccacctcatagatgcagacactaaagctcaaagaagatgagtgccttgcctgaggtctcacggctggtgaatgactgggctgtgactcaagccaagagctgtttgtctccaagactcttaaagactcttttttaaaaccagcaagctattccatttcatggtattctctttttctccctcattagcagattcctacagaacccacatgactctactgttcctgccccaatttatttttgcctgagtctccccactttgggcaaaagcctcgcttgaactatatcgatagctacaatgactgaaaattgtgtcacgtatcacatagaatctctgttcccaaggtacccagagagactgaaataggtccgttaacagtcgtgtgttttacattccacttggagggttaacattcagggtcacccttcttctgagccttaaaaaccaggggtatcaaagtaatgagggagtgcgagcattccatggagtttggattaatgatctgtgagcctctgttcagccctgaatgcgtgtcatttttagagttcagcctggcaagaaaacttaacaagaatcctggtcaaaagaagtctcagtcatttaatgacaaagggtaactggacaacctaccaccagcaatttatttttagaccaagttaagtcatacttctatgcatgacctcactcccatgactctcctgccctgcccccagttactgtcctcagctctatgatgcaaatattctgcagatgtgtctctgccctgcaagattccctagacagctttaccttgactacagatatgtcaatgtccgccaccatagaaaggtctttatgacctttctgaactgaactgaactgatgctagcttgttccatcaagaccccttctttcactgtgcaaactgtcccccaagctcctgtgctccaatcagacaatcagaactttccattcatttcagcaaagttctattgagcttccactctgggttgggtagcaggctaggctggggacagaaagatgaatgagacccatgccttatgagacacatgatactcacagtgaggaggagagagcagatgacttacactgaaacaaaaacaataatgtttcacatccaataatataataataaacaagacacagaggaaggggttatttcttctcttctgagagaataggaaacaacaaagatacatttctacagagaagggctttaaaggatgaataggagttttccagggagaaaaggagaaaaggtcatttctggcagagccaaccaaagcagaaaattctgaaagtgaatgtttgacaggagctgcggagagggaagaagagggtgacacataattcagtaaagtgattgtgttgaacatggaacagcagaggggtgggagatgagcataagaagttgtgatggttccttgacaccttgcttatttttgtaattttttttttttagattttgaaataatttgatcctaacaggaaagttgtaagcttggtataaagagcgctcatatacaggctgggtgtggtggctcacacctgtagtgccagcattttgggaggctgagctgagagcattgcttgaggccaggaggtcgagaccagcctgggcaacatatcaagaccccatctctacaaaaataataataataatgaaagaattagccaagcatggtggtgctcacctgcagtcccagtaacttgggaggctgaagtgggaggatggcttgagtccaggaggtcgaggctgcagtgagctgtgactgtgccactgcactccagcctgagcaatagagtgagacactgtcttaaaaaaattctcataaacccgttttacctagtcttcctaaaatcgtcaatattttaccacacttgctttatcatcttttcttgatacatacatattgcatttgtatttttttatgaattgtttgagaatgagttggggtcatgatattcctttacccctaatcacttcagtgtgtatttcctaagaccatggtcattttcttaggtaactaccatataaagtcaggaaattgacattgacttaataccattatctaatccacaaaccttattaatatgtcaccaattttcccaataatttcttttatagtaacaaaaagaaaatgttgaccacctgtattagtccattttcacactgctataaagagctgcctcagactgggtgatttattaaaaaaaagagatttaattggcccacagttctgcatggctggggaggtctcagggaatttacaatcatggcagaaggggaaacaggcatgtcttacatggcggcaggcaagagaggagagcaggggaaacagccacttataaaaccatcggctttcttgaaaactcactcactatcacaagaacagcatggaggaaagagcccccatgatccagtcacctcccaccaggtccctcccttgacatgtggagattacagttagagatgagatttgggtggggacacagagtcaaaccttatcaccaccctatttacaattgggactccacccctctcaacatgtcctgggccctggctctgctttttctttgtagcattttctgacctctaacatgtagcattattcctatttctaaaatgtctctcccttcccaccatcccactagaatgtagatctatgaggtcaagaacttttgtccattttgctcactgtcatatcaacacccaggagagtgactgccacatgaaagttattcaataaatagtctgaatgactgaatggccaaacctggaggtatctcttcccaacccctcttcctcttatttttttaagcaaaaaacaataggctattttttcatgccaagaaaactgagcctccgtgttagtgtttttctccctttaagttcttgcttggggttttcttattttgcctcctgataggtacgtagggtatattgcaaaggagaaggttatccccagaacagctagggcttcttctaagaatagcccaagtcaactgaatctcccctgggtctcctatacagatgtgaaagtccttgacatgcaatggtatctatccctctgcaaacagagtgagcatctttagatctaattgaaagattaaaaagaagatccccagctggaaggtcaatttatagattccacagttaaatcaagccacattcctaagcacatgggacacaaaccttgcattaaatcaaagacttaatccaagttaagccaccctggatgaggagctagagctggagacatgtaattaacaccagccagtcagcaccaactgcttcagatgacaggtccacagcctggaaaaccttgttacaatttccaggagggctttggggatgcttgttctcaagttccagagacggtgggctttgcttctttccatctgatctcaactactgaccaccaggctccctgcactccagccccaccaacctccttgccacttctcaaacatgtcaaggacgcttccatttcaaggtcatttgcacctgctctctccctgagctccctctggactttgctcaaatgtcacctctctctcactctatttatttctgtaagcctctctcctccttgtcacctgctattccctcctgctgtatcccttcccgccactcttatcccacctgacacactgcacattgtacttatccatttactctttcttcccctgagaaaccccatgaaggcaggacttgtgctttttcattcaatgttccctcaccaatcatctagaacagtatgtagcatatatcaggcactcagtacctaactgctgagttaatttgttggctagttatctgattgattgattgactgattgattgggtggttaattaaatggttaattaatttacctcctgaggctgggcccccatatggccacctagctaagaaacaccatcaaacctggggctgggtattttggttatgaaggcaaataagagctacctagaaatgccctgacgccagatgtcttcaatattctgagacctgagtctctgttataggttggtgtccttgggataaagttcaagttctctgtccctttggttcttaccttgaggaactccatcttccacccctgaactgctcacctaccctccagtgaactagaacttttgtcagctcctcaaagtcaccaggttcttgccacatatgacgtctcttcctagaacagtcctctccatcatgccatagtcttcaactctggccagcacctgctccccaggtgtcccctgtctgcactcaccacactcttcttgcagtgaatcaccagactgtgggttccacgaagcaagagcccttgccttcttcttccccatggtatcccagtgtctagggcattgccagactcatgcttgaatatttgctaatttggataggagttatcatcttatttcacagatggaagttatgaactttttacacacctaatgtacaggaattttcacactaaacaatcctccaattctctgtggataccaattgggtattctataattaaattaaactttggcactgcctacctggtgttaccgtcagaccctatgagtgaagggttccaacccacaagaaggcccccaacctctgaggccagttgcaaatcccaggttgctacctgtactcctaagcaaccagctataaatcgggggttcctgcaacccactctcaggtttgataatttgttaaaatgactcccagaaatcagaaaagtgttttaattactactactggtttattataaaggatgaaagtcaataacagcccaatggaagggaagcataggggaaggatgggagaagggccccatgcacaccagcctcccagctccatgcgctcaccaactcagaagctctctgaaccccatcctttagtattatggaggttccactacataggtgtgattaaaccattggctatttggtgattaggtcaatggttgttgacttcagcctctctcctctccttgaggtgggaagtaagatttggggtgggcaatgagcctaatagctcctccaaccttttaatcatgaggttggtttctctatagccagccccatcctgaatctatctagagctcaccaagagtcccctcatttgcgaaaactcaggaatcgttgaaagggacttgttatgaacaacaaaagatgctcccctaaacccatcattcaggaaattccaagggttttagaagttctgtgtcaggaaccaggacaaagactaaatatatacttcttccttcatcgcagaggttaaatatagtatagtggtaagaccacagctttgaagaccatgagttcaaatcccaactcttccacttaatggctatgtgaccttaaacaagttatctcagctctctacatctttttctcatttataaaataacgatcatggtaaatttataattcattcaacaccgttctcaaggctaggaatacggcagtaaacaatagattggcccaaagtgatattcgagccaaaacccaaatggtgagaagaatttcgccaccttgagcctaaaaggaagaaccttcaaggcagagggaatatcatgcctgaaggtgttgaggcaggaacaacctcatagtgttcaggaaagataaaagaaggccaggccgccaggcacggtggctcacacctttaatcccagcactttgggaggccgaggcaggtggatcacctgaggtcaggagttcgagaccagcctgaccaatataaagaaaccctgtctctatttaaaaaaatacaaaatcagccaggcatggtggcacaggcctgtaatcccagctactcaggaggctaaggcaggagaatcccttgaacccgggaggcagaggttgcagtgagctgagatcgcgccattgcacttcagcctgggcaacaagagcaaaactctgtctcaaaaaaaaaagaagaaggcggccagtggtgcctctggcatccccaaaagcaagcctccaataccacgaaggtacacagggccactttccctgcacctctcggctcctgatctacccaactccagaccccaaggttcacctctagctctgaaaaggagcacagcttctccagccacatctgcctcattttgcctcaactgcaattggaatcgttctctgattggctcccctgggtacgtcctgaccttctcaatcccccacttctgtgccctaccatccccttaagtgacactgtcagccaggtttgcctggctctcaagctgcaaatctctaagacagaagtcaatgggtaatgagaataagaaaatgtgaaggactagaactccagatcttgatgctactggtattagttaggtcagagaagataataatttgacatcctaggaacccaaatttccatccccgtctaactccactatccagtgctaaattcaatggcttataccaatgctatttgattcttaatcagtgtctgctccatctggtccctttacagtactgattctcaaccggggcaattttgctccctaagggacatttcgcaatatcgggagacacttttggttgtcacaactggggtggatggtgctactgctatttggtgggtagaggccagggatgctgcaaaacatacagcagtgcacaggacagcctgcccctgtccccaacaacaaattttcctgcccaaaatgccaacagtgccaaggttgaaaaatgctgcttttaagtaacacagctcaccctgcataaacattaaacatatatataaagagatgttaaaatgtatttgtatgcagataaatgcaaattaaaacattaatgagatatttcacacctcgcaagcagacaaatttcaaaaaggacaaatattggcagaaaagtggggacataggaaccctcaggcacagctggtggagggtatgctggtgtgacctgttactatttagtcaaaggaagattcacagacgcaaggaccagcagttctataagaaagtcttacaaagctccttagaaagacacatacggaaataatcattgcaaggttatttgtggaaggtggaggtaacgaggttgtctatcattggggaactaggcagataaaagtggatgagcaaataccatggggtattagaagtgaccttttttttttaatttttctttttcttctttttttttttttttgagacggcgtttcactccagcccaggctggagtgcagtggcatgatttcagctcactgcaacctccatctcctgggttcaagtgattctcctgcttcagcctgctgaatagctggaattacagttgcctgccaccacgcccagctaattttttgtattttagtagaggggggtttcaccatgttggccaggctggtcttgaactcctgacctcaggtgacccacctgcctcggcctcccaaagtgctgggattataggcttgagccaccgtgcctggccagaagtaacattttagatgtacaaatagcaatagagatagaccttacagctttaatgagagtgaggagggggagttaaaaaaaaaaaaaaaacagcatgagacgattaatacaattccacatgcatcaatctttttcaaagtgtacacattgggagagtaaattggcacatgtactttggaaatttatttgatagtatttactaaagctcaatataaatactttgaaccagcaaattccactcctggaattatactcaagagatatgagtgtttgtgtccaccaaaagacatgtacacatttaatccataatagccccaaaccagaaacagccagttgttaataaagaaattgaggtatatgcatacaatagaatacaatacaacaatgaaaatacggatgcatctcatagacatcccattaagcaaaataagccaggcacaaagaatagacacagaatgcttcctttcatgaagttcaaaaccaggcaaaactaatcaacagtgttagaggtcattacactagtttcctttggaaaggatagactttttttttttttttttttttttgagacggagtctcgctctgtcgcccaggctggagtgcaatggcgtgatctcggctcactgcaagctccgccttccaggttcacaccattctcctgccacagcctcccgagtagctgggactacaggcgcccgccaccacgcccggctggaaaggatagactttaaggattgacggggagactcctgcagtgtgagaaatattctatatgttcatctaggtggtgattacacaagatctatacgtatctaagaaaatatcatgcagtccacataaggtctgtgctctttatgttaattataccttaactacaaataaaacttaggatggaggactttcaaaagatatggattcaattgacaataccaagcactggcaagcatgcagagtaattaggaattttcatatactgccagtaggaaagcaaaatgacatagcccttctggaaaacagtttggcggttttttataaagttaaatatacacttataatgtgaccctgtaatctcacccccaggtgccctaaagaaataaaaacacgtttgtacaaaaacccatccacagggctgggtacgggtggctcaaacctgtagtcctagaactttgggaggctaaggcaggcagatcacctgaggtcaggagctcgagaccagtctagccaatatggtgaaaccccatctgtactaaaattacaaaaattagccgagcgtggtggcaggtgtctgtaatcccatctactcaggaagctgaggcaggagaattgcttgaactttggaggtggaggttgcagtgagccaagatggtgccactgagccgaatccatcaaaagaaaagaaaaggagaaacaaaagaaaagaaaaggaagggaagggaagggaaagaaaaggaaaaggaaaaggaaagagagggagggaggaaggaaggaaggaaggaaggaaggaaaacctatacacagatacacaaatttatagacgctctattcatagttagcaaaacctggagaaaatctaaatagcctccaaagaggaagtggataaacaaacatccacaccatggaatactattcggcaattaaacaacaaacaaactcctgatacataataaccagaatgaatctcacaggcattatcctgagtgaaataagtcagcctcaaaaggttattatcttagtccattcaggttgctatataacaaaataccgtaaacttggtggcttataagcaaacgaaatttatttcacacagttgcggaggctaaaagttcaagatcagggggccagcatggtgagggccttcctctagattgagggccctcctccaggttgcaaatggccaacttcccattatatcttcaagtggtagaaagagcatgagagacttctctggggtcccttttataagggcactaatcccattcatgagggctccaccctcatgatctaattatcttccaaaagcctcacttctaaatagcatcatattggggattatatttcagcataggaatttgcaggaggacacaaacattcagcccacaacatgactttcttgaaaagacaaaagcataatgatggaaacagatcagtggttgccagggactatgggtgggggaagcatgcaactataaggaataacatgaaggacttctttggaatgatgaaagtgttcggtatcttaattgtgctcaaagtggttacattaatctatatatgtgttaaaattcatagaaccatgcatcaaaaaaagagtcgactttactatatgtacttaaagtataaaataaatgagatattgattcagagtcatattccacaattaataactatattaggaataaacaaatacgcgcacacaatatatattcttcaagaatatacacaaacaaaagatatacattaagcacacacgatggcctattaagggtaggaaatgtaagtaactagagtgaggtggtggggatgaaaggaaatgaacccagagacaaatcagtgagagacacatttgataatgcaactaggaagacttacaggagtgagaagcgattgtactcacagctatggtttattacaggatcggcaaggggcaagggacacacagcaggtagaatctggaagaatccatgcacagactcccagtgttctccccacctctctctagccctagggatcacggtgaatatgttctttcagcaacacctcttcagtgtttctgcctagagaagcccacgtttaggctcaaagtttgggtgttttattgagagctggtcacataagcacaaaaactagtaacaactattgaaattccaggctcctggaaaggaagcaggtattctgggcgcgaagcaggtattctgggcgctaagcgggcaaaacagtgttttacatagttagataacaatgcaaaagccaagttcccagatgccagtgaagagccaagcctgaaagcaagcctttctaaagatggcaacctcatgctgactatgttaattctcccttgccctgggtccttgcagagacccatgtggatgtgccacgagcctgtgatccaaaaaaataaaataaaataatttttttaaaactaggatctgcttctggttttcaattcttctattatttaagtcatgcaacagtgttaaccaggcaggctcactagcatgatggatggataaataagtgggtgggtaggccgacggatgaatggatggatagacgaatggacggatggatgaatggacacatggatggatagaagcaaaataaaatcaatactgtatgagccaaacaaaacaatggcttgagcattctgtttctaatgatgctctcaggaatgcagccacaaggaaactctgccctcacctccaccccatgaggcagaaactggccaccagtgacagggaaacaaagtggattcctcgaatgtcattgttattaaaacaaaactagtcccagaaaactgacctgaatgtattttttctctcacttttggcctgactgtctaataaccaaaagtcaccagaaaaaaaaaattttttctcagcaaatgcttaaaaacagagaagacccccaaagtacacaggggcagagaacaactcacaaatctcaagaataaaataaagatgaaagattctcaccctactgcaatgactctcccagcccactgccaccaaagcttctgagattaaaaagagaaattatttaatatatgcagtttcaatttttaaagtttcaggcatgaaagagcttttgctccctaatgatgtccctcagatgtagcaagacctggtctctctttcactgaagaattgccttcattttcaccacagacttcccttgcctcaaagacagatgctcagtcagagaaaggagcctgaggatccacagaaactctctgatattaattgatctgctcctagttttcagttattctattttttaaaacatgcgacagtgttaaccaggcaggctcactagcatgatggatggatgagtgagtgggtgggtaggttgatggatgaatggatggacagatgaacaaatggacggatggatggatggatggatggatggatggaaaaatagatggatggatgtatagatggagatagatatagacagaactagatacagacaaatagagacatcgttaaagagagagagagaggtaattatttatttttgcaacaagtatttattatctactttaggtcaggcactgctccagcttataactgtttgttataacagtaacaaaaacaaacaaacatccactaccttcccggagcttagagagagactataaaaaataaaaataatatatagaattatagatggtgttaagtgctatggagagagcaacatcaagtaaagcgtcttgggaccggctgggaagagttccagttcttaaagaatagggtcaggaaaggactcaccagaaaagtgacttttgaatgaagacctaaaagagatgagagtgttcgggttcaatattactttttaaatagacagacttaactacctgagaaaaaaacaggcatatcccaaaaatactaggacaagggaaaattataaaagttgatttaacaccaacaggtatgtaaaggagatgatgacataatgcttagttcctggcaagatttagattggagaaaaatagcatgacatgggcacacttggaagaaaccaatgggctatcaccaagaaggacctgctcgagctcaagataaccaggaaacataaccacctcttatgttataataatgtggtaacacaaaaagatgggatggcatgtcacatattgactcggaagtaggcaaaaacgtgagaccaacttgggcttagatacacatacctaggaatatactaggtgaagttaaagacagcaggagattgatattctacataaatatggaaatgcactttatgagttcttgagattctctggggatttttcataggtctcacccatcactggtcatgtaaatatgtcatttttagcaaaatcacattctcttcacttctatctgttctatattgctgcaaggactgctttttgaactagggtatgacaatgatctgtcttgatagtgtttgtgagtcaattcagaattacagtgattactaaagttggtcacatattccccccatctctatatgcattcctctttgtgatgtcactttgctgtcctttccactaaatagtagaacctatttctctaccctcttgagtccttgtcatgtgatttgccttgaccaagaaaatctcaaagaagtgatgttatggtaattcacagactacaccacaacaggccagaaacgtctaccttatccctcttgaaatgctaccctgagattgacatatggggagtctgggctagactcctcgagggtgagaaactatgtgaagcaaggtctggccaatagacagccccaaatgccagaattgggagtgaagtcatcatagacaatctgtctctaatggagtccccagatgtgtgcagaataggaatagccccaggaaagaccaacagaagaaccactcacctgagctcagcccaaattgttgactcacagaattgtaagtaaaccaacaaggtggttgtgttaagccattaagttttggataatttgttatgcgggaataaataactaatacagatggtagctacaagtctcttcctatgcctatggttgtcaagaagacagatgaagcaattagtagtggaaactatccattcattaaacaagtacttatggagctcctactctatgcacacacagcctagtggctcacaataagcaacctttacagccactgcttgacgaaatatctccagacaaaactattcctccaccatagcataaggtgatggtctgcccttgtgtatccatccttgtttaagaaacaaactaatgtcccttaactaaagattctccttccagtgaggacaaatgcaactcctcgtgaccactgtttctcctctggtgcccttccaataactcagaaaatctagactattggttgtttatgacttcactggatagcacctctattgtcatcaggccttcaggaggttgggtcttctgagaaatgcctgcccctcacccagccctagcaggccaatccattcctctttgtgtggtggagtcacgccagtgaagtggatgaggagtaggatgggagtcagaaaacttaggttccatttgtgcattctcagacttgtgggaagatacttcaccagccccagccttagaaatgagagtaacagagctgtacaatctctgaggtgttatttattcttaaggatacacttactggcagggaggaaatgctctaagccatttacatacattaccgacatcttctcttttaaccctccaggcatcaggcatctcgagggggtaggcactcccaccttcctgattttacaaatgggagtctgaggctcagaggaattgggtgacttactcaatgtcacacagctagttgcaggagtcagtcttttaactcaggcccatccagtcttaaaaacatggactgaaccagtgtatatccaactgacagatgagtttagaagctatctagtccagacaagcttgaactcagctagtccagcctttcatgcacctcacctatttagtgacagggaagtcattacttctccaagcaacttacattactttaggctgaaaattgcctgcctgaaattcctgctcactaatccctcttggccctctgttaacatcaataattccaccgataattacaaagcacctactaggcaccagacattatcctaagtgcttgggatacacgtatgaaattgctcattccaacttggtttggcccagttttcaagggtttcctgctcaaactcacacctcagcctgaattcccactcctgaagatttcttacctctctgtagtgagctctgttgatggcctctctccatcctgctgtaactcacatggaacctgtctcttccttcatttctcccaatgatctctaagacagagctgtctcatgccgctgactttactgaagctctcaggatatggagggggattacagcatgcaataagccatgacttccacaaagttacttatctctgtcttgaagttcttcactcacccctgccgtaggaaatttcacttccctagcctttcctcagagcccagctgctgtcatttttggggagtcctctaccaagtctcttgaattccacattccctagcctttcctcagagtccaactgctgtcattttggggggatcctctactaagtctcttgaatcctacattccccaacctttccttaaagcccaactgctgtcattttggtggggggtgggggggtcctctaccaagtctcttctctatttccttctaatttttcgcaatggtcagtacacccaagaccctctttccctgagctgggaaaagacctcaaattactatttttttgtcatgcataccaatgcaactcttcttaatctaagcttttctcatctctaccgtactccagaggaaacctccctgcaaataagaaaaccacaccaattaaagtattttttctgggaaaagaaaatatgcagttgtctcagaaggattcctcatgatactcctaggtcaactaattcaaacagcagccaacttttgaaatagaagttttctattaaataatagtaatgtcaactattaaacctgcaccttggcatatgatatgctacattcatttcttcatcttccaaatgaagaaactgaggctcagagagaaacattatcactagctttaaatcactgagctagaaagtggaaaagtgaagattcaaacagtccccaaaccaacacgcctttccagtgcttgaactatgatcaggcaagaaagtgcaacacttaaggtggcactcactctcaggggctgactgcacaagcatgaccctaagaatgggtacttccttaagagcagggtacctagaatccaagttcaggcaagtgcagggtgaatgcagctttaatttgcatcctaagcaccccgcttgcctcaccacagctggggccctgtaccttctcttccacaaacctgaaatgcatgctggacagtgaccatcctgactgggacactagcctggccctctgggcttgcatagcaattgatgcctggctttccctgtgcaggtggtgctgattaatggtgctgttaagaagagatccagctgctgctttcagtttcctcttcctgcagagatccttaattactgggcttcacctgttgagtttccttaaatgacatgagtgtgtatttttaagtgggaaaacaattcattaggaagtgccaacatctcagaggaggtaaatcctccagttaatttcagaaccacactgcttcagccacataagagagcggtccaagggggtactgcttttttctgaacgtcaccaagccaaacaaccaaccttcagcagatggcagggagcggccttgagaaaccacagggaggggtcatgagatcaaaccacccttagccatcaacctttagcatcctccctggttgcccctttagctcagcaccctgggaatgatgggtccacacagccatttaggtactgcttccacacggctgaaattgcatttgcattttattaaataaaagcaatctgtgcaaaagcctagcctaaagttactaacagatatttgagtctaagataatacatcttacagtattagaattcaggttctaagacaatcaccctcaaccgttgtcaatctttacattagggtagatttttgaaacttcaggtccctacaatctagattctgatttaattagtctagggtgggaccctggcctttagtatttttttaaagctgcagccctcagtggtgactccaacgtgtaggcagaattggaaaccactctaatttgtatttaatttttttttatttttatttttggaaacagggtctcactctgtcacccagggtagaatgcagtggcacgatctcagctcattgcagcctctgcctcccagattcaagtgatgctcttgcctcagcctccccagtagctaggattataggcatgtgccaccatacctggctaatttttttgcatttttagtagagacggggtttagccatgttggccaggctggtctcgaactcctggcctcaagggatccacctgcctcggcctcccaaagtgctgggattacaggcatgagccactgcaccctgctagttgttttatacatagagagagagattacaaaatactttctaaaggatagatcctgggtcttatcactgtattgctcataccaagcaaaatgcctggcacagagtgtgccaccgatacatgttttgtgcataaaaataaataatgtcacttgatgcttactagaggcaggagaagggacatagaaggagcaatggggataggtcggccaaggggtacaaagttaatcaggaagaataagttcctgtgttctattacacagtagggcgactggagctaatgaccatacattgcatatttcaagatagtcagagaagaggagcttgaaaatgatcaccacaaagaaacggtaaaggtttgaagtgatggacacacactggctaccctgtttgatcattatacaatgtatatatgtatcaaaatattacactatacttataaacatgtataattatatgtgtcaattataaatgaaatgttaatatgtcccttgattcttgtttgtacctttttccaattatttagccttacatatatatccatgtatatataaattttacataaatgcataaaaagtgagcattcctttgtgtgtgtgtgtgtgtgtgtgtgtgtgtgtgtgtatgagaaaaagagacagagacaagcagagagagagagagaggcagaaacagagagagaggaggagacagggagagagagacggcaaactttttttgctaccaattttggctcatttgccctgcccctctattctcacccccattgccatctccccacctgctccaacacctgccccaccagaaaacctgtactgacagtccagtcagtggtcttctatatagtgtccatcctcatttaattctagacagacatacagacacacatgagtgtgggcaatcattgttttatagaaatgggatcatattctaccaaccgttcccatgtattcaacaattccttgttgcaagccctccaagttgatttctcaaagaactaaaaatggaactttcactggacccagcaatcccatcgttgatatgtacccaaaggaaaataagtcattctaccgaaaagacacttgtgctcatatctttatagcagtgctagtcacaatagccaagacatggaatcaacccagctgtccatcagtggtggactggataaagaaaatatggtacatatataccacagaatactagacagccacaaaaaaagaataaaatgatgttctctatagcaccatggatgcagctggaggctgttatcctaagcaaattaacgcagaaacagaaaaccaaatactgcacattctcacttacatgcgggaactaaacactgggtacacaaagacagaaagacgggaacaagagacactgaggattccaaaagggggaagtgaaggagggggcaagggctgaaatattacctattgagtaccaagtttgctacttgggcaacgagatcatcagaagcccaaacctcggcatcatgcaagatacccatgtaaaaaacctgcaggtgtaccccattaaactaaaaaaaaagaaaaagaaaagaaagcccccaatacccctgatatcactcaccttcactgtccttattgggcacgtaccagtccataggtggaagccccattgcttagtcagccactcccccatggatgagcactcactttgcttcccatttctgcccgtcagaaataactcagccacaaacaggaggtcatctgatgcctgcaaccaccctatacagcacaaatatccatgtgaatctttcttcccatccgcagacacatagccaaatgcctagcaggccttacctgaccccactaaaacagtctttctggccagggaaaattataaagaattatatgagatcacacatacaaaaaaaaaaaaaccttcacagtgtgcagaaggctttgtgtcaaagtcgagctcgcacgtggccgtggccgggttctctgtggccagccccattcacaacacagctctggcagagcactcttcaatagcatcattaatagcccattgatccaattacatttctttctgttccacttcagaattacaatctcctgttccccctgaaagagcccagatagattcccagatgagtatcggaagaggtagctgccatcaggacttgcttgatggacccaagcactcatctaatagtggcactggaagaattaatctggctgatatatcagacctctctcctccgtgggaacttgccattttctccagcctctgagtttttctagtgagattcagagatacagccaaatgtgagttaacccagggacatcctaacactgccctcattgtgtgttcccagcatggggtaggcactccataaataatcgttgaattgaaaaatgcctaaggaggggtatattggggctcaaagcagaccaggtcggctgaagaaatgggctttatccagattgtgactttgcaggttggaccagaatgagagtttgaatctgattccataggtaatgcataaaatgaaaatatatactataaaaaggcaaagtcaagaccttgaatgatagctgagaaaaaagtagagagagctaaatacatattccaagtctaatgggcaggataatgagggacagaggtaggcagcaataggaccaaaatagcattcattcacttagtaactgtataatgaagacctaccttacgccgggcaccgtgctaagcactggggaggcggtggtgtagaagtcattatcccagccctcaattgctcatggtcttagggaggaggccaagacacaatcacattagagccatgaccaggacaggacagagctaaagcctatgacaaacataagcccagggaaattaaggagtatacagggaggcgcctaagccaacctggggaagtatcaaaggcttcctggaggaggaggatgaggaagaattagtaatgttgaatactggcaggtgaacaattcatactgtgagaggctgtggccccagtacccttgcatctgctttagactttgacttctacagtgagactcctggccaatgaggatctatgtccacagtccctgggggtcatcagccctgcactctcccacctccacatctttgtccatgttttttcctctgtatggatagcactctctggttccctctccccagtctgtaaaaccatcaccttcacctcccatcaaggcacagccccagtgctacttcttgcatgcagcttttccaacttcctctacctggaattaatctctgtctctttctctctctctctgaatttcaataacactttgcttgtttctctcttatagtacacagcactcttgacattgtattataattatttgtgtatttgtcttatctcctctgctaaactatgaactccacaggggcagaaaaaaccttgtcttaaccacctttgtattccctgcagcgccttatacaaggcaggtgcttgatacaggttgaatgaagattatgtttaccaggttccaggtaaatggaaggaaattaaaagacagcccagctggaaacagtgggcaggcattacaggcagggcccgctttctaacagctatcataaaactggctgcttgctggagctgtgaatttcccatcgctggttagagaaattctttaaaagggagattcttttaaaaatggttgtcctagatgatgtctaagctcatctaattttcactaggttactacaatggagaatggttgatgagtaagcaaagacagcagaaacccactacacagtgaaataggaacagatgtgtgttactgtcaatgtgattgctcttggttgaatgatgagatcaggggtatttattagattattaaatttttaatcaattaaactaaaagatccattctcagagaaataatgacagtatgtcatgagcaaggattataactaacctaattctaaacatccgaggattttttttgttttttgtagagataggggcctcatcatgttgcccacactggcctcaaactcctgggctcaggccattctcctgccccagattcccgaagtgctgggattacaggtgtgagccactgtgtctggctgagaatcatttttaaagtttgatttaaacaatcgcccatccccagatctgatttggggcatcaatggggccaaatgacatgggtttcctagagagcaaatctccggatgtcatacagatacttaaaaccttcaatggctccccatttccctacaacacattcctagtcctcagcttgatgtttgaggcttttaataatatagctcttgccagctgtaccttacacaacgccagacacactcagaccagaggtttcaatctcaagggcatatagggactcagtggagtgtgctgggccaggacaaaaccacaagggcatgccccaactcaacaactgagcaacttcacaggtccagcccctttgcccagcagaaatgcagactcagcattgcaagctcttctgagttttcaaaagaatcaggaaattaagatttttttttgtagaacctgccatttttcaatgttagcttaaaaatgcttaaacactttgtgaaaaatgcccatctgtggctcagatctctatgatttacttagactctattttttaattacttagatttactaaaaggtgctatgctcgcaccccttcaaatatccctccccgatgtttcctctctctaggttactcctctctgtctcctttcctggatttattccagcccaacctttaagactagcttctagttgcagtcattcctgcagaattacctatttctttttactcttccatattgtcacaatgttttacaatgaacctgagcagcagatgctgtcagtgccctcccacatcccctcagctcccttgatgattttgtgcacaccagtttcccatgtgctttcactcccaacagcctcagaatattggaatccactttctctgaatgcacggagagctagaagcacctgggaatttatgttgcccaagagcagcccttagccaatgattgacaggtggaggagtttaaatacttcacctcccttgcttcttaacgggaattacttcaaaatatgctgcctccagatctcccctgcagattgagccacagttatcttctgctagactttgtttgctatcacacacctgcttgggtttttcctggaaacacttcctattaaactggttttaaatgagccctcatttcaggatctgcttctaggacctttgatagacagcttttgacatgttctccaatgatctccagcaccttctgttaatgcccttatacaatcccctcaccatgagtgtgccatgtttctaaatccaaaagtgatgagtgtcacttccatgattgggatagaagagattgacttccatcttgccaccagactctctagcttgtcttctctccttgtgtgctttgataatgcaagctgccacattgaagagacccacatggcaaagaaatgaaggtcatctctagtcaacagccaacaaagagctcaatgctgccaataactactgagtgagcttggaaatggatacttccccagtcagaccttcacgtgagaccacaaccttgcaccaacatttgattatagccttgtgcaaaaccatgaagcagaggacctagctaactcgcatccatattcctggcccacaactataagataataaatgtgggtcagtcaagctgcttaagtcatggggtcacctggtatgtagcaatagataactaataccagaccccaacataagacgatgtgtaatatttctataattagaaaatattccatcctagatatctcctcctgaaagccattcctgagctcccagaccagggcatttttgtcacctctgtcatggtcttcatcatcctgaatttaataattaatataccctgcctccccatgtttttctcccctactgatcaccttgaaggcagagctttcagagagaaaaggtctgatatatttctttattcatcatctaagcatagtatcatataggagatgcttaacaaatgtatattaaagtaattgatttgttaattgttttccatatgagattttggccaagtgcctccctatataccattattctccagatgccaaatcaagggtaagggaggccttcaatattcagcaaaatctctactccatgcatcccccacatcattttctaagcagtttcttcctttccatcaccagggtgcttatcaattgtacattgacacttcctcccatctgttcaattcatctgttggatggtcactctctgccacttcagagcaatggggagttcactctgcctttcatacccctctgggaagcccaggaaaattatctctgattaatatcatttcttcttttgggtctaatgacaaaattacagcaaaatccagccctactttgcaccacacttggaaaaaaatctgctcagcttttgtctgccaaccacagcaaaaacttgattaaccaggactcagtgcacatgggcagagggctttttccccccagttagcagagggatgaaactgaaaatcccatttatttcctcccttattaacagaaaaaaagaatcaataggttagcccacattgctacccactgtcaataaattcccccaaagaaattgagtctctcttggaaagatgagcattcttgcaggcctaagaattgtgtattctgggactaaagatagtgttagaaattagactgaatcagcagagatctttggcatgtggaatttttatttaaaacactatttgctatcacttatattcccgtctttgcccttctcccagaagcaaagtataaaaaatgtgtgttctcatttttcaagtgttccagattcctaaagtccagttcatataaattgtagcatattcttatttatatgacagagactgtcacaggcatctaagctcaagcttattaaactgaagtttcctattctatctactcaatgggttctcatagtctcctaagcatctcatcatcttcctcctccctctgagacatgaaactcctacttggaaccttttcaaggtctacggcattgtgcaaaaagaaaaacctttcttgttatgcaactaacagatcctttcagttccaggggaagaaggagccaccagaatggtcactcaataacttagccaagtttcaactctgttttaagggaaaggaattgcaaagaaaggaaacattcgattattgagcactgactatgccaggcactgaattgagaatgcattttttactcctaatcatagcctgaggccctgcacgatctggtccctgcctgcctttttgactacacctctgaccatgcccccacatcacttaatatgctatacccacactggccctttttattttctagagcatgccaagctcttcctaccccagggcctttgcacttgctggtctctctgctgagaatgcttttgcccagatatgtgcgtggctcactccttgtcattcctcatttcttaattctaggccacctccaaaaagtaatcccgaactaagctgtccacctcccatgctaagtcattctttatcttgttcctttattgtattttttccataacacatcaccattttaaattaacttagttattgcctgcctccccatgaatatataagcttcatgaaagcaaagggtgttcctgacttactcactattgtgaaaccaacatgctagtacatgcctgccatataatagaatctaaaaacatttctggagtggatgaataaataagtttctctctgaatcctgccaagataaatattgttattatccccgttagcagataaggaagttgaggttccaagcagattaggaaatctcacaagtttgcacagctagaaggtgctagagcaaatcttacaaccacggaactgtctaactccagtgcgtgcattctccatcattcctagacactgtgtgggaagacaggagattataccttaatcaattgttttctaacttctgttcatgaaaaatgtctgggcagctgtgacaaggaaaaaagtcttttatcagctcacagttgtgagtgtgacagagcagggatatatcttctgcatcaaacattgccagtttgtcaaatatcagaatagaattgaattttaggaagacactatttctgatgcagctgtttcttttggatcctctcaatgggcagagaagatcccagcaatagaatgggtgaggcacgcatctgtctattaggatggttggaatgcatgaatttgataagccctatatttggtgagggatgtctgtcctcaccccaaaccttctcaccaacgtgacctcccgccagcatggaagccagtgttacaacattgtgagaactgggccctgcaactgtgctggtggccatttttctgggaccctcttcttttactgatacctttgggagtactcccatattcatttccgttgggcatctcattcgttgctgtaattcttgtcttcagttcaaagctcaaaagcctcaccataaagaactgggttttactttttggatcttgatccttggggaaaccccctaaaaaagtctatatctactatatccactccccatcttccagtcatctctgagcatggctgatgtagggaattgctcaacacagtttcaaagccccaaacaacaagctagctctggacatgcctacctgctatggtttgagttcagtttgtgtccctccccaaaattcatctgttaaaatcctaatccccaaggtgatggtattaggaggtgaggcctttaggagatgactgggtcataagacaggagccctcatgaatgggatcagtgactttataagagatcccagagagatctttgtccctcctatcaggtcagattatagtgaaaagtcagccatgtaagaaccaggaagcaggtcctcagcagacactgaatctgtagacaccttcatcttgaacttcccagacctcaaaacagtgagaaataaattcctgttgtttataagctaccaagtttatggtattttgttacagcagtccaaatggactaagacactacccccattctatttaaaagaaaataatctattagctcaccacatttactgtgctgaaaatttccaaccagaagaaaaagctttatggaggtgacccaacgatatggaggtgcttacaaccccatgggtggctacaagaatcaaagagagaaattatagttcaaaggcaaaacgtatactatctcctcatccctattttttcttggtttaagtcatttttattaagagtcataatgttctctatctacatgacactttccatcttcaaacattaactaattaattgactgaaatggtatctcgggagcatttatcatctatcacattagccagagagccagggaactgtctataaaagctgttgaacactcagtggaggcttcatctttccgcttcctttcccagaaatgtttttttgtgtgtctgcatatgaatgtgcaatggggaaaaaaataaaaagagaggatttgacttccaccaactgctataaaaatttacctctgggagacatggaatttcaattgtgaaataatcagtcttggaaattgtcctgtcctccaggaaaagaaaaaatatgtagtttaacagcaattgcccttcaaaacaattactaattataacgtctataaagaaaaataccctcgataccattactcctaataaagccaggcgaatctatagaaaggaattagctggcatgtctaaaatctgacaggagagctgttggggatgggtcagaagaggagtgagctccaaccagcttaaaaacctggatccaaagctttaggaggcttaccacctggagcaagcctctcttagcaaattggcaagattagcacaagaaatcaggccaggacaattacaaattgagaacccaagtcatttttcctgaccttccttccactctatcccatcccagctttctccatgaacctcttaacctcctcttcaagcagatgtcacggtacctggaactcatgccttacagctcaccatcttcccttcaccacagtcctcttaaagacatatgcccaggtagggttacaccaagcccctgagcccttggattgaatttgactgtcagatcctaactgtttgaaacaacatatgtcatggaggaaggatcttggaggaaagaaagagagaaaggggccacagaaaagagaagttggtggcagtgctgaagatagacaaatggaaaaagtccgttctgatttcaaattctccatcacttccctgctgtgaagcctgtgtcaagttgatttgaactctctgatcctctcacctcagtttctcaaagtgaggggaaaatatacctgaaagcctactttttaaatgagtgttcagttgcagacaatggaaaccactccagctaccttacgcagaagggaagtgattaccagatgtaagctgacttaggaaaccattggaaggacccaaagagttggagcttccaagaacaattccctggtcccccaaatcactctgcctctgctatgatggtgaaaactgctacctgcactacgagaagtcaccacatcaggaagctaatggctgcagaactacccagactctgcagagatccacaggagcaaagtgaatggcattatgccattttcccctcttaactcagttataaattcaagacgcaaagagtatctgatttgcagaacctgagtcatagtcagaatcctagctgcaagggagtccagtatattgaccttttagcaacccagcctctgcagtatagaatgacacagttgacagaggctggaatggaaactgaaggagcccatgcacaaagggcaccacccacatgattcagggctgtcaagagaatcaaatgagatggtgtttacaaagcacctaatatgctgcctgatcattagtagcttctcaataagcactacttttccttcactttcccaaaattttgctgcagcttggccctctgaatcatcctaaaagaacagaagaaaaaacctggaagcagccaaatgaccttcctaacttaaatgtgagggttttttgggcatctttcatttagcaaccttatcaaacatcagttatctctatttaaggcattcccccacctccacagaaagaatgaatcattttaagcagtagtttaagcttttactctatccaaacaaaattggcaaaagatcctctccctggataattacattaacattatttatctaaccactatttttctttttctgagatggggtctcgttctgttgcccggaactggagtgcagtagtgtgatatcagctcactgcagcctccacctccctggctccaataatcctcctgcctcagcctcctgagtagctggggccacaggcatgcaacaccacatttggttaactttttgtatttttggtagagacagggtttgtccatttgcccaggctggtctcgaactcctgacctcaaacaatccatgcacctcggcctcctgaaattacaggtgtgagccactgcacctggccaatctaatcattatttactgggcacctactagttgcctggcagatgtgattcctctccttcaaggagttaacagtctaggcagggtaattgtgcaaaacttgtaagattaaaattctgataaaacattaagagaagagatcagagtgccataagccagaataaagagggtgaaactgattctactcagggagtcaggaaaaatctccctgaggaagtaatgtctacactaaaacctgaaggataaggaaaagttaacctagtaaagagtgggagggaagagaatttctggcagagaaaacagcacatgcaaaggctgagtatttaggaaaccagaagaatacctgtgtggctggagtatgttaagtgagaaggagagagaagcgataattactttggctatggaactccaggctattatctggggtgacattttccctcaggttggaatccagatatgtgagacaattaacatttcataaaaataacttttgaagcaatgtttttccacctttctgtatctcagttgtctcttctgtagaatagtgttaacccttcactggatgatcatgagtgttaaataggataacaagtatacgattatgacaagaaggctgggcccttttgagcacagcagcgacatcctcatcatcttcttcagtgtttagccataccactccagagagctccaccaagaaccagagaggtgcttccctacctgcatgacttctctgagatgctctctagcccacacacagcagaggcacccacctgacaccttcacctggccacatctgattggaccagagtgtacacctcctactacccggacctatcatattcctacacctgggaaactcttacattcagatagaggcgcaattgatcagagtgcattagaagctggagctgtaaggtcatgaagaagaagtcccagggccctgggcaagtagaaactgggaaacagcaaaccctgagattccaacggcaggcgccagtctgcagagaagagaatggagcagatgtgcagaggtaagctccagagagtgaaatggagaaagcggctgattaacaacattccaagtcccatgaggtccagctgcatacgtcggatttccagagagccttgtgtgtccagacagtaaaatttcatatccactttaatctctttgaatgggtttctattccttgcaattgaattatcactgtctcagaggcccatcaaagtggagagctgaggccacccttccttaaatcagacctaaaatgtaaccctatcttgctaacaggacataataccggaactgaggaccccaccaccatctcaaggccttcacacaggctattccctttgcatagaaagctcttccacccgctccttttgcaaaactaaatctcactttcttccaggctgccccctttgagcatcgcttgtaaagactcccactccaaagtggacccttgctgtggtttccatagctctcaggacttccctttgcattgtgtaactcactttggatcactcgtaagatggctgccaccccaccatatgtgacattccacacttgcatcctgtttcttgcttattccccagggtttgagtgggggacacatagtagctgcacaataaacatctgattaatgcatgatggatagtctaaaaggatcaaattgacattctactgaaaaagaagagtttcactttagcctactaggtgctctactctatgcaaggtgttggaaacacaaagatgaattagacatcatccctgtgtttaggtcttgaaaagcctaagggaacaggtggataggtagataaatacgtttatgacaatgtaacaacgtgagtgttaggagagagagagactacaataggtgtatttctgaaggttttttggatgacaggggaagagagagagatgttgtagagggtcctagtggcccccacaccatcactcctcagaatttttgcagaaaacaaatgtagtgagcatctgattgttggctgctcagcatctactctctaattctgaatatagcacttcatttttccttttggaaaagcaccttcctgccctctcagcccaccagcacactggtgtaactggtatcaattcaacacctctgtccccagagtcaaggatggatgtgtgtcccaagcctagtcaatcagaatactccatcctcacaaggagtggttcagggatgatcatgtgacagtttagttaaatgagagtcaatctgggagtgtaaattagttcaactattgtggaagacagtgtagtgattcctctaagacctagaggcagaaatgccattagacccagcaatcccattactgggtatatatcccaaaggaatataaatcattctattataaagatacaggcacttgtatgttcactgcagcactattcacaatagcaaagacacggaatccatctaaatgcccatcaatgatagactggataaagaaaatgtggtacatatacaccatggaatactatgcagccataaaaatggatgagatcatgttctttgcagggacatgaatggagttgaaagtcactatcctcagcaaactaatgtaagaacagaatatcaaacactgcattttctcacttataagcaagagctgaaaaatgagaacacaaggttacctggggggaaaaatgcacactggggcctgtcagtcagagtggtgggggacagagagcatcaagaagaatagctaagggatgttgggcttaatacttaggtgatgggataacctgtgcagcaaaccaccatggcacatgtttacctatgtaacaaacctacacaacctgcacgtgtacccctgaacttaaaaggtgaaaaaaaaaagataagagtatatctcagaattcctagggagaagcaaggagaaagataagctcttctgtcactagaacccctaacctggcagcagccttcagctgagctgctgaagcctgtcttgggactacaaggggaaaaaaactccccaaaaataaatcttacaaggaaagtagcaggcctgagagaaaaagccacttctgatgtcagtttgaacatctggatccaaatagattcatcctggatttttcagttgtgaatcaacaaattctactttttctgtttaagcttgagttcctgaacctcaacactattgatagtgtttggctggatgggggctggcttgtacattgcaggatgtttagcaatgttcctggcttctagagccattctcacccacgagtcatggccaccaaaaacagctgcaatcattgccaactgtcccaaggggcaaaatcacctcctattgagaaccactggtttaaaccagttttcaggttcctattgcttgcaaccaaaagtcacgagcatacagtaacctatcaaataattccctacccaatttccaggaataattctcactcctacatgcttttactttccgtggtacctggaacatctttctatgggctttgctttccaaagccagtctgttgattttacattttttaaatattggtgtcaatgaaagtaagtcaatcagatcaagaacagcttagctctcagtcccagcagtacttgtacaagtgacatatttgggtacattgattatactttttcttcctcttaaaaatttaaacatcttccctcatttactttctttattttagaattctcagcagtcaattttcttttatctacaggccttcccttcgatgggaaactaatcaataagaaattagatttttgccaaggtattttaaagtaatgtaaccagcatatttttctctcattcatgactttattattgtgaaatgaaaacagaaataccacatccttgaaaccctcattttattaagctccatcacagctaccttcattcatcggagccatctcttccaatgtcattgttttgggtgaagcttgtgtttgatcaccaacctcatattttaaattgaaactcagctggagtagagttcttccctctgaatgagggatagcagtctggtaattagcagcaaagctcaagcagacaggctgcatccacttattctatctgaaattcttttccttttcttttttttttttggccagtaattactcttatcttggtgaagctgacccacctcttggcccctcaattggagtctccctttcaagaaaatatcacattgtgttgaataagaaaatcaaaatggaaatgaagcttcaagaggagtctagctaccatcttttcaattgccttttgaaacatcagctgggtggactttcaagacgcaggcacagttagatatgtggatctgtttcttagattgcacttgtgtatctgaagacatccattatgcctaagagggaaggaaatgagcaaggacttcccaatgcatacaggtgcttcgtaacacctggtgatcttgttactgaaacaccagaggttcagtctaggttctaatgcttgctgcacagaaagccaatcactgagacaatgagtattgccagggaagaaggcttcaattggatcctgcagccaagaagatgggagatcagcatcaaatccattcccctagctgactaaaattaggtatttttatagcagggaagaaatgtaaccatttgtgagaaaacaggaattagggagaggaaaggaagaggagtttgtcaacaagaagcaagtggttgcttaggcagtcatgacggatgaagggtcgggtgctttcactgtccagattcagagatctggtgagtttcagctccttgattctatctgggaagcctgatggttggaggcctgagaaaggaactcagataagacaaatgtaacttttgcaagtttcaagactgggatggccaatttctatgtgtatttaaaagaaaccataaacatcagttctatgggacaattgggccagtttcagttcggctcagttttttggcatggaaaggaggaagagactatcaataatattaacagtatagctatattgatcctttattagagggggagaaatctatttatttgggagagtagcttcaaagtgtgccaagtcagggaatcaaaggcacattgggaacaagctgaccaaacatcaaccagcatgaatggtcttgagccctcaagaccaagatgagccaagaacccacttcaagtttgaccaaagcagacagtaaataagacctccctgtaggaactccgctcttgttgcctaagctacattccaccttccacactgataattttatcacaaaaacaagcaaatgcaaaggaagaaagtagtgatatgataggatgacacatgatctagccaattccatctagaaggcaaataaaggatggaggcttggtgggattaatgcatttattctttccagaaattatagagcccttactctttgtctggtactgttctaggcttggaatacaagcaaagatccctgcagttgtggggtataccctgtaacaggtgaagagtgacatatcagaggaaggtcagtgactacagatgaaagggattgcattgagcctggacatttcccatgtcctacaagcctcctcctgcctttggtagaggtgagtgtaaataaacaaaatgtttcctgcactcaaatgccctcctctattttatttgttatgggagcaaacttccatctccaggacagcagagcgtagagcatcttctggtgtggtagctgtggtgagttagcttgagctgaagccaatgtgggcaactgtctacttaaataactcacctattcacctattcctggctgccatcaacaaagttggagcctccaagaagcagttaggattaacatattaacacagaggacggtctttttttttttttttttttttttttgagacggagtctcgctctgtccctcaggctggagtgcagtggcgcaaactcggctcactgcaagctccgcctcctgggttcacgccattctcctgtctcagcctcccgagtagctgggactacaggcgcacaccaccacgcccggctaatttttgttgtcttttttagtagagacagggtttcaccatgttagccaggatggtctcaatctcctgacctcatgatcagagggcggtgtcttagtccatcttgcgttgctataaacaaatacctgaggttgggtaatttataaacaaacaaaggtttatttagctactggttctgcaggctgtccatgaagcacggtgccagtatctgcatctggtgagggcctcaggctgcttccactcatggtggaaggtgaagaggagctcgcatatgcagagatcacatggcgagaggggaagcaagagaaagagggggaggtatcaagcctttttaacaatcagctctcacaggaactaatacagcagtaactcacttataaacatgaggatggcaccaagccattcatgagggatctgcctccatgaccccaacccctcccatgagtctgccacatccaacattgggatcaaacttcaacatgagctttagggggacaaatactgagacgatagcaggcagtcagcaaaaacaagaactagcatgtgttgagtctgcttgattcatcctttcacatatatcatgtctcatttcacttccacaacaattctatgaggtatgtatgtattagccccatctcacagatgaagaaactgaggctgagagagactaagtggcttgcataagatctgtctgactccaagttctacagcctttctgcattgttgtgctgcctatttcacccaataaagtccaacccatccgcatgagagtgttaataaatcaataacctgagtacttcctggggctggctctgtgtctatccctagattgggcactgtgaggggtatgaaattaaggtacagtctttgttctcctgagactaagttagctaaggaaacaaagggaaaagcattcattcaatatttaacgaaccataccaacactccacccacattcaccctatcttacgcaaatacttgtggatcccaaaacgtgccatgcctttgcacaagtctgcaatgccctttcgtctctcctctctgcttcaacctacatcatcttcatctcgcaagagttagatcatccagaaagcccctctaaacccacaggctagttggtggactttcttctatgaattccatggaccctggtgctcctctccgccataaaactctctggaaaaaaaatcagtgagagcttcagaagttagggaaccctgtaagtgagatgactggggagaaaacaaaagcctgagatggggaaatggctaaagacaaaagaagaaggagtatgtatgtggcccaaggtggtatcatctacaacagaaaactgacagccaggtaagggactgtatagagctagggatgttgtcacagtaagaaatagaagatatcattactcaaagccaagttaattacgatgttctgctttcacttattttttctaagtgcttccacctctggaagcatttctgatcagcacaactgtgaggttggtagtaggtattatcattcccatttagtggaaggagaaactgagatgctcagagaggttaggtgagctgcccaaggacacacagcatgaagacactaaggcagcagaatggttgagatcagactttctggtgtcaggcctacagctctcaaccacctggccatgtgaccttggacaagagacttaacttctccaagactcagtttccacacctaataaaaggggactaaagaatctctacttcgtagagatgttgtatggtgacataatcatacgagacctttgtcagtcctggacatatctgtaacaataaatctttgttccactcatcgccactgcttttgtttcgctgggatcatctgcaaaaccgcttgtgtgaaactctggtcccagctgctctccagggacaccagggcttccttgcaaaatatagcagccaagatggctttgggcccccaagtttctgagctcttgtttgactgcacatccccttccttagaaagccagcatcttcacgtttcctttctaagctgccaggaataaatgccaggttctggctttatggaacagtttgggaaataattagtttgccttccacagaggccagagttcacttctaagatatttaaaactctactgatggcttaaaataaatatcacaatggagatgtcaaaatatctatgtgttcttacacatgacattggaggggcagggagactaaaaaaatgtaaatggatttaccaaaataatctcgaggtaagacctttgaggcttgataccacagaagtgccatattgtttttaagtttcttttttttttcttttgtaagtttatttttctcctcggagggcactgaaagttttgttgtgagaagcaataaagttctgttttccaaaagagaataaaagcatgattgtatttttaaaaatcaatcttaataatttccagccattactttatgagcttaatgcaattcccaaacactgataactgatttctccaactggaagatgcgaagcgcacccaacggatgccaagttccgggctgagtactttaaatatttattgaattattaatcctcataagtgctcagtgaggcaggaatgatattcctcattctgtaggggaggtaatggagaccctcaggtacttgcctaaaaacatggggataataaagcagaaagtcaggattgaagactaagtgtccttatcctgactccatgctctttccagtgagttcttcaccccatccagatctaggagtgctgaacactcaacaacattatcaggcaagacaacaaacacacccgtgtcaactggagtttgtggctagtataaagcaatatagagtaaatctcaaagagaagtaggtcaaagaaatacctacaacctcaagaatatgtccttttctggctgggagcagtgcctcatgcccgtaatcctagcactttgggaggccaaggcaggaggatcacttgagcccaggagttcgagactggcctgggcagcacagcgaggtctcaactctatcattttttaaaaaatagaatatgtcctttcccccttgcctgcctggataaaaccttcttctttatctcttgctgcttcccacttcgcattttctgctctgttaaacatcaaaccgcttctgttgcccagaactatgtctcaggttccatgcagctgtgcctctgcaatgctgtgcctttttcccaaatgctgttcctctacaatccacttagcaaactcctgttcatccatcaaaaccctgatgaaacataaccttttaaaagaagtcgtcttcatccctctcccacttctagacccaatggaattcacgcgttcctcttagtcttctctccatagcatgtacatgcttacatttttataattattgcaacgtctgggatttgggtctctgggttagttgattggtttggctgatatatcagtctccctcacccgactggctttcctataggcaggggctatgcctgaatccacctttgtatcctctatgcccagccctgtgcccaagtcaaaacaagcatcgaattgaattgaatcaaaattgaaaatgaaaacaaatatcttggagaactagaatatagggaaacaagtgttaatgttgtaagagtctatcgcagagcaatcaaccagaccatgtttccctaataccgattacaaagctggcacagaggcaagacggagcagcagtggggatttatgctctctggacatctgttgggcgtctcttctgataaatcctcgccttgccctgctgacgatctcatctttcagaagacagaggaagcgacagagaaaacggttacttgccactaaatcctggcaacgaggaaacactggttaatgagaaaagtggaatccttaggagaaaaaaaaatgggcacataatcctagagttaatgatggtgcaagaaaggaagaaagaaaataagcacccattaaaaacctacagtgtgccgcctactttacgtgtgttactacatttaattctcacaacaaccctgggaggtgggtttcagtcacttccattcacagaaaagaaagccagaaaatggagagagtaacttgcccaagctcataaaaggcaagtctatctgcctgcaaacccccagttctaacctcacaccaggctgctgagcaaaaaaagcaaggcattgcctgacttcaaacctagagttgatgaataaggcagcgtcaatctgtataggctaggtaatgatacagtaacaaaacacacacacacacacacacacacacacatatacatacacacacactgaaatccaaatcacggtcatgtgacacgatcaagctatttcttccagccttggcagctttctaggacaggcagccaccctcctttgtgtgctggctgagttctccactttgcttccacctcatgaggctccatctcaacagatgcttcagagcttgcctcattcagggggaaaaaaaaaagccccggaggatctcaccccagtaattaaatgctgccacccagaagtcacatatgccacttccactcgtgtggcacaactcaaggccaaggggcagagaagtgcaattctccacccagaaggaaaacaagccagaaatggttgtgcaacgaaaattccaaccacagtagctttctgaaagatgagaaagaaagcttccatatgcagcaatgaacactggccaagcccggcctctgtgtactaccaggggagagaggagaaacatgaaaacaaaaattaatatctagaaggcaatgatcaaaaagagagagacaaagggagtgatgttgatgggagaactgggttatggaaaaggatttcacaagaatcaccaagcacatgtggaaggtcagtgccatgaacaaggtccccggacacaacccaagaaggaaatattgtgcaaaatagattggagtgccttcgtcagttcaggctcctataacaaaataccacagcctggggcttaaacaacagaagtttctttctcggagctttggaagctggaagtccaagatcagggtgccagcatggttggttccagtgagggttcattttacggtgtgtagacagcaactttcttgctgtgtcctcacttggcagagagggagagagcaccagcttctttctcttcttatagggacactaatcccattgatgagggctccacccttgtgatttaattaccacccaaaggccctacctaatatcatcccagtgagatatcatcccgttggaggttagggtttcaacacatgaatttgtgtgggggacacaaacatagctccatagaaaagagtctcagaaattgtgtctacccattcaatttttaccattcaattccattcccgggaattaggaagaagcaattaataggactaataagagctgtctggaggctcttattgacaaggctgtgagcaaaggatacaaggtgggacacaaaactgctttgaaaatggaagcaagatagcctgatagaaaaggcactgggcctttgccactgtcctctgtggctttataaagttacttaacctctctgagccttggtttgcttctatgtgcaacgggaataatatactatctgcctcaaaaggtagttgtgaggattgagaagatcctgcaggtaatatacacatcaaagtgcccagcaagatgttagaacaaggaaaacaatcataagaaggatgagcatgacaataaactctccaattggataaattcaagttggttgtctcaggaaccatctgtcttgtaactctctgacttcatttcccaccaccctattattgcctgaatttgctgcattgatcttttttgttcttttttttttttctttgagacggagtcactctgttacccaggctggagtgcagtggcacaatctcggctcactgcaagttccgcctcccgggttcacgccattctcctgcctcagcctcccgagtagctgggactacaggtgtccgccaccacgcccggctaattttttgtatttttttagtagagacagggtttcaccgtgttagccaggatggtcgcgatctcctgacctcgtgatccgcccgccttggcctcccaaagtgctggaattacaggcgtgagccaccatgcccggccgaccctttttgttcttatttgatcattccaggaatgctcataccttagtgcctaggtactttggggttctctcttcctagaacacttctcagaaaatgagagaatgtcttgttcaagtgctattatatttactcattgaaaccttccataattacctacttgaaattatggcatccactccactcctcacactctctattctctttccttcctgtattttcacattggcaattatcatttcctaatatacaaaatcatatacacttttttattgtctatccccccttcattagaatatattctgaaacttagatgaattctccagccaagaaaaacatctgacacatagtacgcatttatcactacgcatcgtttttgttgttgttgttagagcaaccctgcatttctctactctgatccattacattttaattttatattttagcaacagggaatgccttatttctttgtggaggtttttttattttgttgtttgttcttctgttgtttgtttttttgtttgtttgtttgtttttgagacggactcttcctctgtcgcccaggctggagtgcagtggtacaatctcggctcattgcaagctccgcctcccaggttcagccattctcctgcctcagcctcctgagtagctgcgattacaggtgcccgccaccactcctggctaattttttgtatttttagtagagatggggtttcactgtgttagccaggatggtctcgatctcctgacatcatgatctgcctgcctcggtctcccaaagtgctgggattacaggtttgagccaccgtgccgggcctagggcatgtcttatttctatatactccttctacaccttttattctggcattgcaaattcctagcaaaacatcctgaagggttcatgctgaaagggcaacctactcttcccatactatcttactgcaacttgttcttacttcagtcttggagctgcccattacatgagccttgcagtggcttggacatcaacctgtgagaagtcgccagcatccaaaatatctgagactcacagaagactcagcataagctcctgtaacgactgtatttcctcaactgcaggatcaaggtgtggctgtgaatgtcactctcatcagtactcattttgtactgcttatggtttgtttgtttgtttgtttgttttcagggaaatgaggttgagatcaaaaccaggacccagcgcatgtgattctgtatcataaagaatatggaagtacatgtatggagctctagtgaaatttgcttggactcagttaagatgcaatggtttgcaagtagttataacacctgaattcctgggacaacttccgattacttttagaacacagagacacaatatgggcatcatttcaatatcagatcttatttgtctgaaaataccagatcactagggcaatgaaataaacaaccagctacaaaccagctacaaattatctagagggtacagcctccattctctacaggaaaagagattcacattcttagtaccaggcccagcaataaacaccttaaatattaatgttattccatttcatatccacaataagcactacggcaaggtaaattctatcggctccattttatttttaattgcccaggctggaatgtagtagtgcaatcacaactcactgcagcctcaacctcccaggctcaagccgtcctcccacctctcagcctcccgagtagctgggatgacaggtccatgccaccacacccggctaatctttgtattttttgtagggacagggtttcaccatgttgcccagtctgctctcgaactcctgggctcaagcggtcctcccgcctcggcctcccaaagtgctaagattacaggcgtgagtcactgtgcccggaggccccatttttcaggcaaggaaattaaggctcagaaacactaatatcattgcccaacttcatgcatatagcaaaagacagggttagaagtcatagctatgtcttcctgactctagactgtgctttttccactacaagggatgaaactggggaaaataaactgctcaaatgaataaaatgctcaaataaaaaaatacaaataaataaataattttatattttagcaacagggaatgccttctttgtgggtttttttttattttgttgttgttttttttttttgagacggagtctttctccatctcaaaaataaataaataaataaataaaaataaaatgctcaaataaataaaaacaaaccaatgaacaggagtgctggtagacctgcttctttgcgactgcttaatggcttaaagggccattcatttggttttgaagccaccaaagccagggcaaggtgaaacgtttagtccaaatgggtccctcaccccatttgggaaccaatcactgtcccctatagacctagttcattgaaggcatttaactgaatccaatcatccacattactaattgacctccacaagccaacaaaagaaaagatcggttcatccaattaaccttgggactagctcacccttgatctcaatgctcatccagatggagagaagtcctctgggccaagattgggaaactgagcccccctttctcaaagctggcagctttttaaaggccaccaactccatttcacaagagatgaggagagacagatggtgaatagagtacctgcaaaaactcaaagatacacagggccagtgtagcaacttgcacacttgcaacttgtatttccccctttttcctcccaagtagtctcagtctcccaacctgattgtcttataagccaaaacagcttttgcgcagcttgatagcctcagccttgatttttaaatgactagaaattcaggaggcaaaagagcgatagtcttagctcaaaagtcaaccggacctgggtttgaatcccagatccacagcacaacagctgcaaaaccttgagcaattagtgatatctctaagcctcggtttcttcatctctagaagggaaatacaaacatagtgtcttcctttcattaggttgtggctgtgaagtgaagaaattacaggtaaagccttcgacatggggctcagcacacagcaagtactcaataaatgttggttatttattctaaaaaggaaaaaagttagctagtctataaattttataggtcaacatcagtactgaaaatgactattcaccatactctgaatcttctcttgatccgtgcgcttgtaatttctgaattttaagcttctcttaagtccttattggggagtcccttgggatagttaatgttctcccaagactatctgcactgcaccccgcttatgttccttctagaaatataatcaggatgagcctggaaaatctcatccacatcatggttttagccatcgaatcattccctcaataaatacgtattaatcatctattgatcaccaattactgtgctctgtacacagagctgggcactgcatatccagctcatctccactttggtggccaagatactggaaactcaaactgtccaaagcttgatgccatgggctaaactgtatctctaaaaattcatatgttgaagcactaacacattggagaatgtgatggtatttggagacggggcttttgggaggtacacaggtttaagattaggccatcaggatgatccttatgacgggattagtacccttgtaagaaggcactagacagcttgctcactctctcttgaccaagtgaggacacaggagaaaactatcatctgcaatccaggaagagcccctccccaagaaccgaatcagcaggcaccatgatctcagacttcccagtctctagaactgtgagaaataaatgcttgctgtttaagccatttgatccatggtattttgttaaagcagccagaactaaaacacttggtttccaacttcatcttaaaacatgcttctcccctgtctcctttcttggttacaggctccactgaccaacccaaactgaaatcatttgagactttccctccctcactctcatatccagtcagtccccaactcttatttgtgggttctagatttgaaaaaaaaataaaaataagaagctcttccatctttataaacagagctttttctccattcatgactgatttctactcatcctcagggctcatggtgtctcctctaaatcctccagcagtcttcaaggcggtcttattactttcactcttccctagtagagtccctgccgaaaagccattttctgaaacacaatcctgaatctgccccttttctgcttaaaaaccttcaagaattcacaaaacctccaggatatagtctctgctcctcagctgggaaatcctaccataactgagccctggcccccgcccagccatttctcaacaagcccccttcactttagattcctcagcctaattgcaacatccccaaatggtccaggtgctttcaaacctccacgcctttgcaggtgctgttccttctgctccaaccccctctccattccttgactgctgatcctatactttatcctcatctttcataggttcaaatccccccatgggccattactgagcccccttcccaggctgtataaggctactactttcctctctgttccaatatattcccactataataaatatgacacagtctattgtaacttgttctttccctctttctctgtccctcctccgcataaccagatggtcactcctttgagaatagagagatcctgtcttatttattttcaatgccatgcaggttttaaggataaaaatcaagaaaaaataaagttttggcaactgtgctaaagccagaaatttctgaaaatgactgtttaatgcataccatggggataattataacgataataacaatatcaactattttaagtgctaaatatgactaaacattttataggcatagctcatttaatccttttaaccaccccaggaagaagtattatttttgctctcttgttttttggatggggtaaatgaagcacagatctctctttctctctctctctcacaaacaaacacacacacacacacacacacacacacacacacacacacacacacaatgggtttgggattcagaaaggcacagttcctaaactggctctgtcatttatcatctatgtgacctgaaggcaattcacttaatctctatttgtttcctcatctctggaataagaaaagacttgttgtggtaatttaaaaagactatttacaaaagtattgaaccaggagcagtggcatgcacttgtagtcccagctactctggaggctaaggcaggaggattgcctgagcccaggagtttgaatcctgcctgagcaacatcatgaaactgtctcataaaaaaaataaagtttaaaaaaacaaaattaaattgacacatagtaggtactcagtgatattgtctctttctccaaacacttacccagacctgtatgcttcaggaatagtattaatgtcttaaaccgggtaactagtctgctgactggctgagattcaggcatgtcagtatcgcttggctccagcttacctaatagactagctctgagtctgtctccatccatgtctcccacccacacaactctagcctcatggataaggtgaggctcagggagtgtgacctgggacgaggttagaatgagcatgactgccatgcagtttgcttgataacttcgaaaaagctgaaagcttagcagtttggttttgaggttgtgatgcaaacgtgtaagtgttcgatgtgtatttctgtcaaccacacctgaaaggccgtgtgcaacaccatgtgcccaggtgcggaagctcagagacttgacgtaggcgggaatttgccgtgatagcatttaagcagccatctgttttccaggagattctggagccaccttccccatcaagcccccctttcccgtcctcacgcacccccagctcctcactcaggaatacattgacatttccagatgtattgattacaggggcagactagctttgggcgggagaagggagagaaatggattgactttattatttgtgggtggaaaaaaagaataaacaagggtgcttttgtttgaaggacaaaaccaaaattatcggttgaatggggctgaattaagcacttaaagttcaatccttccagagtgctgacagtgcacaggcggagatcaatacagaaactatttgggccgtggggaacctgggccctgcttattaaccgctaattataccaagttttctgccgaaatgggttagttcccttcaagattacgatacaacagaactggttggcactgtcggacccgggtctgggatccaacccctggagcaggaagtccaaggttcaggataaactcccaaaggccttctatttatggagcccacttcccaatttgccacttgcaaatcagggtgtagacagcccaccactttcttattagaattttaaaataagactgccaacggcaagacggatatttcactagggctttcagtacggccacaccagttgttcaaaacagggacactctcccacgccagtcgctcagcaacctcccctgctacctcacatgcccctcactctcattatccaggcttaacacctggccgagcaagggcctgcggggcccgctccagcatccactctggtgaatctgtgctcatgccctcccggtgctcaaacattttgagcacgaccctgaccacaggcaacaactttccataatccgttagtcaccagccagtctacaaacccagatgccttcccgtggggagggggatattgattgtacatacacaatgtcacacacacacacacacacacacacacacacacactatataaatacacaactgcatgtatatgtatgtagttatgtatatatacagttatatataaccatataaaatatggaaaatttatatttcatattatattccattaactatatattaaatatgtatatatactatatatagttttatacacttaatatttaacgtactaaacatttaggactaaaactaaatatgtactatatgtatgtaactatagttacatatagtacatatttagtactaaatatactatatatactaagtatttacatatctagtatacataaatactatatataccatatatatttatatataataatatataaatattgatataattacatataatatatatttggcactaaatatactatatatgtatagatagtatgtgtatatataatatatactatatatgtgtgtatatacgatatactatatataatactatatatactatagatactgtatttagtatatactaaatttactaaatatatattcagtatatactaaatttactaaatacatatttagtatatttagtatacataaatatttatagttacatatagtacatatttagtactaaatatatactatatttatatatttagtaaatatataaatgaacatgtactatatgtaaacacatgtaaatatataaatgtatatattaaatatataaatatatagttacatatagtacatagtatatatgtagttatatagagtatatatagactataaactataactatatatatatatatatgaactatacacagccatccctcggtatacacaggggactggttccaggacccccaggtgtaccaaaatctgtgcctacccgagacctgcagtcaaccttgcagaactcaaggacaggaaaagtaacccttcatctacacaggggttttgaagcagttcacatctgtattgttcaagagtcaaatatagatagatagataggtagatagacagacagatagatagatagatacacacacgtatatagatgcacacacatagtttatgtaaagttggtgtgtttgggagatatttccatgttgccacttatcaatttatcttatctttttaacagctacatggcgcccagtagtacggatataccataatttagccactccctagttgatgaatatttaggttatcccacattttctctatcacaaaacatactgcaatgaacaccttgaacatatattattctgcacatatatgaatatttccataggatggattccaagaagtggaattgttgcgtgtttttaattttggcagatcttgacaaaccattcctactttctctcatacaaaaatgatggtgacatgtgcccccatttatctggatggtttgcaggaatgagccccctcaaagtggtctctggtcaacacaacgggtctctgtgatgtacccacctgcatttagcaatcagagttcacagagcactttccagtctgcttggcacacattcgttcacaaagaagctgagggaagcttcattgctgcttctaaaaagcagattattccagatccccgcaaagcttccagtctgttgagctacctgaaaatgacaagcagcaacttccctgcagagacctggagtcagagtttggccatcaattgccacccagaccttgaagccactctgcttgtctctagggcaatgtgaactcctggccatcatgccttgcttaggatgtcaccaagtgtcccctgaaaaacagctgtcagtctgtccctctaatcataggacctcaaacccagcacagagagccaaatagaaagcggatcctattccattccctttatctccctgtttccattaaaaataaaagcctcagagcatgcaagcaggcagaggagagggaagtattgtccacagtcaaagcatctcgacctccagatcagtcagccagaatgtcctgctacacaagcatttttattcgttccaggatgttcttgaggcagcttccaaaaatgcacataacataacaaaattggaaagtgcaattaacagacaaagtgagaaaaatgaaaaatatatatgagacaagatataaagacccaacctaaatgcctaccaatgatagactggattaaaaaaaaaaagtgttatatatacaccatggaatactgtgcagccattaagaaagaacgagctcacatcctttgtggggacatagatggagctggagaccactgtccttagcaaactaacacaggaacagaaaaccaaatactgcatgttctcacttagaagcgggagctaaacgatgagaatacatagaggggaacaacacacactggggcctatcaaagggtggagggtgggaggaggaagactcaggaaaaataactaatgggtactaggtttaacacctggatgatgaaataatctgaacgacaaacccccatgacacaagtttacctatggaacaaaccttcacatgtactcctgaactaaaaataaaagttaaaaacaaaaaaagaagaagaagaaagaaagaaagaccgaggagaaagaaacctatatgaggcattaagctctgcacaatttttaggcatttggactccaacaacagcaacaaaaaaaggcggatagagggttcgggagatggaattacatttagtgtctatatctacaatgtgcatgaaaataattcccacattttgactttaatcacagaggctgggcatggtggcttacgcctgtaatcccaacactttgggaggctgaggtgggtgaatcacctgaggtcaggagtttgagaccagcctgaccaacatgatgaaaccctgtctctactaaatttaaaaaaattagccaggcatggtggtgcatgcctgtaatcccagctacttgggagactgtggcaggagaatcgcttgaacctgggaagcagaggttgcagtgagctgagatcgcaccactgcactccagcctgggcaacaagagtgagactctgtcttaaaaaaaaaaaaaaaaaaaaaaatcacagagtggaaaataggaaataaagatggcacaactttcaatttctcagaatgggtctgtttctcatttgaacagcataaaatccagccaggcctcctctccaaccagcaggccaagactcttccaaactgacctgacaccccgccatacccaatcttggcaccccacccacttccccctcctcagggtgctgcccaaaccagacaaaaagcaggcgccaagatgctcccacaggactaaggctcatagtgaccttcttaaaaaaaacaaaaacaaaaaaacttagttggcaactgttaaacattgggaaattgtacataaaaaatcctgatctctcactttttaaaaaaacaagtggaaaagaaaaataggcaacataacatctccccatagctggagctggggccgccttggaggagaaaaggtacctcccattttgtgcactcagcccactttcctgactcatgcccatgcaaaccccagctaggcaacaaatacttatattttttgattattatttttttttagtagaaacggggtttcgccatattagccaggctgatctcgaactcctcgcctcaaaccatcctcccacgtaggcttccaaaagtgctgggatgacaggcgtgagccaccacccctggcctaacttttcaatttttttaacagagagaaaacttaacggggtgagtaaaatggcaccaaaagacctgaacttggacccatgacttggccgtccattttctgaatccaccaaatgaggggtccgacactgaatgacgattctttgcacctctgacaatgttctttcttttgactgacggaggtcccactttccagggtaggggattttgctggtatctacgaaccatgccaacttggcttaaacggtcaagaaagaggggggtctccataatggggccatttcactctaatttcttcttgaaatgcttacccgactggtcccctccctcgccccttacctatccctttcctctctagggttttgctaggatgttagccggatgtaaggtacacggacgaactgcaagcttagaggtagtgattggctttgcaagcagaaacaaaaacaaaacaatgaccaaaaaaaaaaccccgcaaaaccaacaaaataaaacaaagcacctcttcctttgtttaaaatacattttgcgttaaaccagtagcctaccaaaggcagcctggagccttaagtgtgttctggaagctgagccttgagcgccatctgggagcagagggcggcactgcagcctcccgccctggagcttcgcctccaggtccttgcagactttccccttcatgatccatctcttctcctgttgccccaaggtctcagaagaggggatgtgctacaatggggagttatgggttttgcaatcagaccctgacacttcactggctgtggggtcttgggcaattcattgcctttctgcaacatgaggacaatcacacccaccttactgggagactggaagattaaaaaagaaaaatgacataaacgggcttatagcatgcagtcagcaaacttatccccttccgtcacagtgccataactcagtctacagacgagtaactcggggagggggtttgtttggctcatctgtaaaacagggctgctggaagccgacattgcataacccatatgtacaacaactggcacacagtgagtgctcagctgttaataaagggaaggaaaagaaactgtaaatctggctctgttataggtcctgaggttaagcaaatagagagacagttataaagataagtaagacaagagagccaaatgtaaataataatatcaggtaattaattagatgtatgaacaaagttcaaatcagtgtagcttccaggctatatcaattacctcgcttaagccctctacgccctttacaacacaggactgtcacccctgcccagtttacgggccagccaaggagggttcagaaacagcagggaatgtcctttgggcttacgctgtttgtgaccctgcttcttctcggatcctagtccatcttcatcttttttttcccaaaatggttttctcatttctgccactgaagttgaacaaattcaacatctgatttttcctttccctgtctcccctctgcccacaccctcccccagtacttcatcctcctgaggtcggctcgatcccaacttcatgtctgtcccatccagccctcttcaattccactctcctctctccagttatgacccctggatgcctgaagaagccttctaactgtgctctccactgtccagctctgctccctccaatctgccctgcatgagcccctgagggatctcaccctttcagcaggtccacctacaagtataacccctctaggtgacataccttccttcgggaagcttctcccaacaaccactgacccacaagaatctctgctttcctcaaacacaagtagacttcgcaactctgcctacctgttagaataacctgaagaagcttcataccacactgttcaccaacaagcacacaaaaagatgctcgatgtcattagccatcagggaaatgcaaattcaatcaacaatgagagaccactccacacccacaaggatagctataattaaaaagatgaacaacgacaagtattgatgaaaatatggagaaattggaaccttataataccgctggtagaaatgtaaaatggtacagtcacttgggaaacaaggctggcagttagttcctcaaagggttaaacagagttatcatatgacccagcaactccactcctaggtatatatatgtaagagaattgatagtttctgtatccacacaaaaaacttatatacaaatgttcataatagcagtattcatggatatccaaaaagtggaaaccaccgaagtgtccatcaactgatgaatggatgaacaaaatgtggtctaggaatgacgtgctgatccacactgcaacacagatgggtctttaaaagctatgtaagtgaaagaagccagtcacaaagaaccatatgttatttcaatccatttatatgaaatgtccagactaggcaaatccatagacacgtaaagtagattaatggttgccaggggttgggggaggggaaatgggaggaaatggggagtttctggtagtgactacagggtttcttttcgaggaaatgaaaatgttcggactgtaggctgagtgtggtggctcatgcctgtaatctcagcactttgggaggcttaggtgggagggtcacttgagctcaggagttcaagaccagcctgggcaatgtagctagatcccatttctacaaacaaaattttttttaattagctgggtgtgatggtgcatgcctgtggtcccaactactcaggaggctgaggcaggaggatcctttgagcctaggaatttgaagcggcagtgagccatgatctcatcactgcactccagcctgggtgacaatgtgagaccctgtctctaaaaaataaaaaaagtcgattgtggtgatggttgcacaattctgtgaatatacgacaaactattaaattgtgtactttaaatgggtgaattgtatggaatgtgaattatgtatctgaataaaacttatatttttaaaaaaataaacctcccattccaatcacttcctcattgttcaatatggcttcatatatttcttcataaataaatatactgatttaatacgtgtttattcgcttattgtctaccacaacagtaaaggtaatttcaatgagagcagagcctatggcgcattcacttctatattcccagtgctttgagcatggcacaaaaggctactaaataagtaagtgccagtgtgtgaatatatgagtacctgtaagaatcagcaaaaataaaatactgtttccagggccccagccccagagattcagacgcaattgatctgagggagagcctgacaaaggtctggctcaagacttcttgagtgataccattgtacaaaccaagacgaagagccctgatccacagcagttgtcatctataaccctaaccctgtgtcacccctgcagatgaggcttcagtagctcaccattacctctacagacattctaaattcaagttaaataacgcagatgaaggactcaggtgagtctgggactttctgtatcagaatcgtcacagatgcctcaaaaaatcagattcccggaccccgttggagacattcagatccttgcagacccctgccagggaattaatgagttcaggttcattccacatgcagattctcgggactccctccaggaaattaaattgagattcccggatttaaccccctggaaggggtcccaagaattcacgtgttgaacaagtgtcttttctcagacatgctgaaggtagggatctacagagtcacattcatgcaaggtctgtggcacaagacctggctctgcctgcatctctggcttcatctctcaacattcatgcccccaccctgtgcaggtccaccaaccccggctactccacgtaacagaaatggcctttccctactccttctcttggcttctgcaaccagcctcccaaccttcactcaggtatcaaagtggcaagcttttctgggttccgtgtctattctgagctcccaagcctcctacagttgcacttaaccagggatgattgtgcttttcaagggacatgtggcaattctggggattttaattgtcatattgggggggtcactactgccacctactgggtagaggctaggaatgcttaaacatcctacaatgcgcaagacagcccccaccgcccccaacaagaactatctggcccaaaatatcagtgtaactgaacttgaaaaactctgctatagtctattgtcatgtgagttcctcgaaggcagggaatgtgtaacactcacctgcataacctcagataccacatacagagcctgacacacagtatttggtaaatactagtggaatgaattatccgtaccttgcatctggcattcaggtgtgttcatttctgccctattttattccagaaaagacgtgtagatacttaaaaaaacttactcaatgcaacaggataaaatcagtgaaggtatcgtagaagcagcagctatgatgaagctataggtgggttgagagcagttattaggattatttttatagccacaaggtagagataagctgaaatttgactctgggcttctggttggcatccatgcaataaaaatgtcccagttgctcaagggaagcacagctctctctaaagttgagaggtgtggggcactgggccatagtgagagtgaagtggacaaccctttctttctttttttttgttttttttttctttttgagatggagtctcactctcttgcccaggctggagtgcagtggcgcaatctcggctcactgcaacctccacctccctggttcaagtgattctcctgcctcagcctcccaagtagctgggaccacaggcgtgtgccaccacgcccagctaatttttatatttttagtagagaaggggtttcaccatgttggtcaggctagtcttgaactcctgagctcaaatgatccacccgcctcagcttcccaaagtgctgggattacaggcatgaaccaccacacccatctggacaaccctttcaacagcaccaatacaccaggagtctttcacaactagttgttataacttcctctgagttcttttcctcttccagaactcattctctttctctttcccatgtaatttgatagtttctttctatctcttaagtttgagcttggccacatgacttgttttggtgaatgaaatgatgatagacatgatacaagtaggagctttagatgtgtttgtgcagctggatgtgaattcctgaatctctcccatcaccatgagaagagcatgccctggctagccctctggttcaaagaaggtaaaaaaatacctggagtcaagctcattcaacttaacccacagacctgtagcctacagcagaaccacacagctgagcccagcctagctcagcacaccccctgctgacctgcagttgcataagcaagcccagctgggttcagccaccccccagtcgcagatgcatgagctaaatatatgttcactgttgcatgccacagagtttggggaagattcactatgccccattattgacaatgggtaaccaaaatatctcccaatagcaagttaaagaattacgccaaagcgtggctaaataaataaatgaaagcaatcttttggggggctaagatagaccaaattattccatgttacttaagattcctcccaaactaagtagtaactccttggtgatagatcatattcttccaccaagtgaccaccactgagctgggcacataagaatgcttgatgccaatgtgtcaatcagtatttgattgggaatatagccaacccatttcaagagaaatgctgtgaactaaagtcaaaatgttggcaacactgaacaatcaatcgactgaattggacagtcaatagattcagatgctctaaatgccttccattatatcagatctgccaaaggtccaaaaaccaatgatgcagtggcaaatttcctggtctcatctcccacgcagcatccactctcccccagatggttgagttctttctggtcatcttagatccctccagaatggattttttttacctctcatgcttgcgcaaggctcaacttcaattcgaagaaagccttcccatacttccttttatgaaattacaagcctgggatccctaccttgtctgctcagaaataaaacagactcagccccatctacacttgagttagagttgagagttgcatactctcaactcctcatgtggctgagttgctaaaggtgttgtattagttcttgcactgctatgaagaaatatctgaagctgggaaatttacaaagaaaagaggtttaataggctcacgattccgcaggctgtacaggaagcatggctggggaggtctcaggaaacttacaatcatggcagaaggcagaggagaagcaggcatgtcttacatcaccagagcagaaggaagagagagaagaggaaggtgctacacacttttaaacaaccagatctcatgagaactcactcactatcacaagaacagcaagggagaaatctgcccccatgatccaatcacctcccacctggcccctttttcaacactgggaattacaattcgacatgagatttaggcagggacacaaatccaaaccatgtcaggagtgaaccatggagtcaagcagtcctggtttctatcacagctctgccacttatatgctgtgtgaccttgggaaagcacttagcctctctgagcctcggttgttctaactatacaatggacataatatttacctactttaagactgttcttaggactgagaaaggtaaggtctataaagtacttagcacagcccctgacacgtagttggtgcttaattaatgctcttatcacttgattttgaattcagagagtagacccatcacagcagagctacagtggggtggaaaggggaggtaacggaggtaacaggacccactatgagcacctactgtgtgctagcagctgtgctaagcactttaaatacactctctcatttaatcctcaccaccacctactttgtcaccattgcttctataacaggacatcaagtaggaattctccagttgttctggatcaatgactacagcagacagttggtacctagctcagggtgagagatccccaagagaaattgctccaaaagagggtgatcacacatccccagtttgccctgcatgatcccaatttatacctgttgtcttaacatatctattaataacttctcattccctttcatactcagaacagtccaaatctgagcaacaaattatatggtcacctgtcatggtcaccagccaattatatggtcacctgccatggagccatgggggctgattgcaagaaggaggggctagcatctctatccctgagctgcagagccatgagcccctctagtgcgatcatctgagtaagatggagtgaggacactcttggaaaagctgactctaagcaaagcttaatgtaggaaaaggacaggggcaggcatctccctctcattccctgtgccctaagagtgcgtcacagatgcctgtgatttcatggtagaagacgaagccagagatatagatgagaggctatccaaggagccactaagtgaggggcttggagccacagatgattgaaaggggccaaagggaggcaaggctggccttcccctaagggtctcagtgacagatggggcacatatgacattgaaaccaagcacacgatctacaccagaaccatctcatttgcaaaggttttgagcagcaaaaccagtgttacacagaacaagatcagaaatgccacccataactacgaccttgccaagttaagtagaaataagcctaaactccccgacccactttcctccccatctccacacacaaagagaggaatgggagatgcataaagagctaaacatgcccttcgcacgcgcctcttcaggtccctgccatggggaagagagataacgtttgtttgtttgtttgtttgttttttagatgcagtttcattctttttgcccaggctggagtgcaatggcccgatcttggctcactgcaacctctgcctcctaggttcaagtgattctcctgcctcagcctcccaagtagctgggattacaggtgcccgccaccacgcccagctaattttgtatttttagtagagacggggtttcactatgttggccaggctggtcttgaactcctgacctcagatgatctgcctgcctcagcctcccaaaatgctggaattacaagcatgagccaccgcatctggccagaagagaacttttcattggatctgaaattggagatttaagtcagactgaactaagttttttaatagctgaaagtggccagaaagttaagggacctagcacccactggggtagaaagactgaacatacaactgataataatatttaagaaaaaaaacaaaactagttcatgcttgtaccccatggagttgaaacttctccccaaactaattactgtcgtttaatagacacttggtgctgagtgctttacatattttccttttagggaaaactctgagacacatgggctcaggggaaatatttgttgacttggatggaaaaggcccatcctcagcttttgttttgccctgtcctgctgtctgtctgtgttaagttcaatgcctgaggctttgccaacttgtattccctgtaagggcagaaattcagctcatgtaaacctcacagtaatccttatccccatctaacagagatggaaatggagactcaaagaggtaaagaaactcacccaaagaaccacagctaaaacatttagcagagtagggatttgaacccaggcctgtccacctgcacatcccttgcttgtttgccttattgagctgtctcgtcaatttcatcttcgccagccccaattctcagatgtcccctgggcctcctcaataccatgttgcaggccatagccccaggctgctaaatggcacgcagcctctgtgggagaagactctaattgtgcctgaccacaaggtctgcagggagttaataaattattccaagagaatatttgcactgaaggccttattgactggagtccatttcctgagttggcataattttttttctccagcaattgttataaagcaagtgcaagtcttgaaacctcaactgtagaatctcttgattatcaccaagtatatgggcttccaagcctacctaccttcaaagtcaaggtcatcacaatgggataatccctcaggcaaaaagaaagatgagttttaggggtcttctggtttccatagaaaaggcgctccaggccaggtgccatgactcacgcctatagtcgcagcactttgggaggctgagtcaggaggatggtttgaacctgggagttcgagaccagtgtgggcaatatggtgagatcccatctctgcaaataatacaaaacaaaattcgtaagcatagtggcacacacctgtaatctcagctattcaggagactgaggtgggaggataacttgagccaggaaagttgaggctgcagtgaactgagatcacgccatggcactccagcctgggcagagtgagaccctatctcaaaagaaaaagaaaaaagaaagaaagaaaaagaaaaggcactccagttccattctattctttatggaactattcataatttacagattaatgtcacttttctccctcccaccctcatctttctccctaagaaaaccacgactgatttgttgcagtattataacacccaatgagtagaaacaacccaaatgtccatcaataggggaatggttgaataaagcatgatatagccacccagcagagtactatgaaacatactaaaagaatgagaaggacctctacatccccagtatggaggagtttccagttcattcaaatgaaattagcaaggtttcagaaaagagtatgttgttttgtataaggaagtgaaagggattagaatatatatttgcttatattagcgaaataaaataataaaaggctaaaaccacaaaaaaaaagtttcctttggtggagagagaagaagaagggtaataggaatgaaaatgggacttctctaaggctgagaagaggggagaaccaagaaagaggagtgtgggagtgctttgttctgccaggtgcagtcaataggtgccttgtctgtaaagaatttaaaaaacagtaatacaatcaactattaaatgcaatttggtatctaaatcaaattttggatccaggaaaaaaggacattggtggaaaaactgatgaaatttgagtaaagtctatagttaatagcattatattaatattaatttcttttgacaaatgtaccatggtgatgtaagatgctaacattagggggaactggatgaagggtaactacaagaattatctgtgctatttttgcaacttctgcaaatctaaaattattccaaaacaacgtgatttctaaaaatatatgaatttcatacacgagtattatgacatgaacaaaaagcaattaaaggtcatccatttttattattactggcaattctaaacaatattggtgatagaactctcccactcctccaaccagggcaactaaccactctgtacctactctgaggatggcttttttatttagttattagtttggaacaatgttaatgttctgtaaagacaaatataaaacaaaatttgaaaacaaaaacagaaagagccacaatattgggcatgaataacccaaatctgagcactgtcaccacgtgctcctctcaaattcagggttttaattttttattctttattacagacaggatctccctatgttgcccagcctagccttgaactcctgagttcaaatgatcctcctgtctcggcctcccaaagtgctgagattacaggaatgaaccaccaggcctggcctcaagttcaggtttgagcagctctcaccaaaatcccactgcagtaaaattcacagtgggcttcaaattcaggtccatctgagtccagatcccaaaagctttctgacagatcttcttgagggtgacaaaacagaaataaaagatcagaatgggaacttgcagttcctcttctgtcctttatagaagtgtcaacggggatgcaaagatttcattatcaacgggactggcactgtgcccttctatcaggcgtctgctctcacagggaaatcaacttggcacagcctcaagcattgaacctaacactgagaggcagccgggcagagcagaaagaaagctgaagacaggccctttccatccaagtcaacaaatatttcctttgagtacgtgtacctcagggtttttcccaaaaagaaaaatccctcttcatataaaccccctagaaagaagtcattgctgcctcaaatgcatgtattcagctgcaaggcttctattgctacatgctttctgattatagccaccatttctaagccctgcaggtgtttgcccatcttggatcctttgaaacagctccttcccctgccccatttgcttccagatatctgcacggctcagcccctccatttatttgggcgtttgctcaaagccaccttttcagagaggccttcactcaccaccctatcaaaaccgggtcacacctcccatctctctccattctctatacctactttatctccttaatgctcactatctcttaacatttattcatgtgttgacttgtcttccctctctgaaagctccataaaagcagggtctgttgcatctccagagcctactattttttttcggtgtaaacagtaggtggctcacgcctgtaatcccagcactttgggaggccgaggtgggcagatcacgaggtcaggagattgagactatcttggctaacacggtgaaaccccatctctactaaaaaaatacaaaaaaattagccgggcatgggggcgggcgcctgtagtcccagctactcgggaggctgaggcaggagaatggtgtgaaccctggaggcggagcatgcagtgagccgagatcccgccactgcacaccagtctgggtgacagagcgagacttcgtctcaacaacaaatatatatatatatacatacattaggtgcaaaggccctggggtgcaaacgtccatgcatgctaaaggggagaaggaaggccagtgtggccagtgtggctagagatgagctaagggaggagaggagggcagggcctttgtagactacagcaagtggttttataagggtcttattctgaatgcaacaggtagctgctggatagtcataagccgtggggtccgggtggtggggaggttgacatcctctgattatatttattttaaagatcattctggtttctatatgaagaatagactgaataaggcaagaggtaaagcaggggaccgattataaaggctaccagaatagcccaagggagatgggatggtggcttggattacgggggtagtgctgaagagaggaggcttgtgggtgtttcttggtaatttgtggataaactagatgaggggcatgagagaaagaaaaatgtcaaggatgactccaagtttaaggagctgagcaagggagtggatgatagtggcatttactgagatgggggttctgcagaaaatacaccttgaaaggggaataaaaagttagttatgttttgtcccagaatcacagcaataataaattagtcttaatgcattaagttttggggtggtttaataggcagaaatcgatcactgaaacattctgtctaataagtactgtttccttgatttcaggatgcttttgatggagtaatgagcgtcaattaaatgcacacatcaaatgaaaaacacatcacgattttagaaacctacttaatatcttctttagagaaacatctattaaagtccttagcccactttttaatcagattgttagagttttttttttgctattgagttgtagaaattccttatatattttagaaattaactccttattatatagatggtctacaaataatttttcccattttgtgggttgtcttttaactcgattgtttcatttgctgtgcagacactttttcgttttacatagttctcatcatttatttttgttgttgttgtctgtgcttttggtgtcatattcacgaaatcattggcaagaccaacatcatgaagtgtttcccctatgttttcttctaggagttttacagtttcgggttttacttgtaagtctttagtccttttttagttgattttcatgtatggtgttagataaggatcctatttcattcttttgcatgtggttatccagttttcccagcatcacttattaaagagacaatcattcccctattacatattcttggcaccattgttgaagattatttgatcacatatgtgtagatttacttctggacttgctattgtattcctttggcctatatgtctgtctttatgccagtaccatattttattttataccagttttaattactgtggccttgtaatatattttgaaatcaggaagtgtgatgcttccaacactgttcttctttctcaaggttgatttggctatttgtggccttttgtggttctatacaaattttagactcattttttctatttctgtgaaaaatgcctttgggattttaatagggattgcattgaatctgcatattgctttgcatagtatggacacttgaacaatatgaagtcttccaatccatgaatttggaatgtctttccatttgtttataccttctttcatttcttttttttttttttcttttgagacaaaggctcgctctgtcaccaggctggaatacagtggtgtgatcttggctcactgcaacctccgcctcccagattcaagcgattcctctgcctcagcctcccgagtagctaggactacatgcacgcaccatgatgcctggctaattttttttattttagtacagatgggttttcaccatgttagccagaatggtctcaaactcctgacctcatgatccacccacctcagcctcccaaagtgctgggattacaggcatgagccaccatgccgggccaccttctttcgtttctttcaaggttttataatttttagtatacaagtctttcacctccttagttaagccaacaagtttatgaaaaaatgtccaataccacaaataatcagtatcactaattgcaaatcaaaaccacaatgagaaatcacctcacacctgtcagattggctagtgtcaaaaagacaaaagacaacaaatgttggtgaagatgtagaaaaattgaaacctttgcacactattattggcaatgcaaaatggtacaaccactaagaaaaacagtacggaggtttctcaaaaagttgaaaatagaactagcatatgatccagcaatcctacttctggatttatacccataaaaattaaaatcagaatgtggaagaaatattagcactaacatgttcattgcagcactgttcacaacagccaaaatggggaaaaaacctaaatgacagattaatgggtaaagaaaatgtggtatatacacgcaatggaatattattcagccttcaaaaagaagaaaatttgggatgggcacagtggctcacgcctgtaatcccagcactttgggaggccaaggcgggtggatcacctgaggtcaggagttcaagaccagcctgaccaacatggagaaatcccatctctactaaaaatacaaaattagccaggcatggtggcgcatgcctgtaatcccagctactcgggaggctgaggcaggagaattgcttgaacgcaggaggcggaggttgcggtgagcagagatcgcaccgttgccctacagcctgggcaacaagagtgaaactccatcagaacaagaggaagaaggagaaggaggaggaggaggaggaggagaagtgggggggaagggagggaggggggaggtgggagggggaggaggagcaggaggagaaaattctgcaagatgtgagaacaagaattaaatcttgaggactttatggtaagttaaatatctgtcaaacaaagacaaatatttcttatttccacttacaggggtcatgtgaaatagtcaaatgcgtagaacaaaagagtgtaatggtggttgccagggctgtggggaggagaaaatgaggagctactcatcaatgggcgtgaagtttccgtcaggcaagatgaatgcgttctagagctctgctgcacattatgtacctagagtcaacaaggtattgtgcacttaaaatttgttaagagggtacgtctcatgttaagtgttatcacaataattttttgaaaaaaaatctgtttactatatgccttgacatgaagaatataggtaccagatgacgtatctatgcactccaagctctgtgtctcacatttatttcaatcacatgtagataacagcaagaatctttagacaactcagattgcatctggcttatcacctggtttgtccctaaatttatcgtttctacagagtgagcagacatgtccctctttctctctctctccctctcagggcatatttcaataacgttctctttttgatgaagtcacacaagacgcagaagcagtcctaaaactcaatttatggaagtcagttgagaccagactttggattgaacctcccaaacctgcctaattaatgacacacattatggcccctgctcccctaactgaatgcagcctccaaaccttgacgtgttttcccaacaataaaatgcagtaaatgaatgagtgtcctgagggaccgtggcaggaataaagggaaagccatgaaagatagatgatgtctcaactaattttatgatttatcgatctccactttgctcattttgcaatgcgggagagctcatttttctgccaggcccacagtggtgtcacccttgctaatagatatgattaccatccccaaaactgtgtttgtgaaaataagaagtgtggcttctctgctgctgctgacctcagcagttttcttttattatgtgctggatccgctaagaagcaaaattgatgtacttatccggggactctgttggacgggcacaagcattttcctcatttttcttccaaacaagttcatctttaagcaagtacagattcatggtttaaattacggcattgacacatcatctgttttcagtgtgtgtattcttacaaggaggatcttttatgtgatcagagagaggaagagaggggatagaggtgtcacccacgtgccaagttgagtttaaagatatacatgttaggacacaatacaggctgctttggatggttcaccaactgcattcagcaaatattgattgggcacaggtattgtgctaagcatgccgggggtattcagtcatttaataaatatttattggcaggccaggcacagtggctcacacctgtaatcccagcactttgggaggccaaggctggcagatcacgtggtcaggagatcaagaccaacctggctaacacggggaaaccccatttctactaaaaatacaaaaagtagccaggcatacaaaaataaaaaaaggtgcacgtgcctatagtcccagctacttgggaggctgaagcaggagaatcacttgaactcaggaggcagaggttgcagtgagccgagatcgcgtcactgggcgacagagcaagactccgtctcaaaaatacatacatacatacacacatacatgcatatttattggtgatttcatatatatagctggaattatagagcaaaataggcaatgtctcttttatcatagaaactatgtcctgattagaaaagatggaaagttcaaaataataattatgaagtgcataaaatagggtgtgttagtcaactatgccacagcagtgctgggtagcatacagccagtaactccacaacagcaagcatgtgtacctcatttatgcaactatggtttgtcctgggtttggctgatctaggctgggcttggctccaggccacatgtttagttcatgtctgttccttgcatctctcactcttctgggaccaacaggttacccagggcatgttaccctcatggccatggaagaactaaagtaggtgagcccaaccactctatcacatttcaaatctctgttcacttctacccactaatatcctgttggccaaaacgagtcatatggccaagcccaaaatcatgtggtagggaagtaaataccatccacaattggagcggggaggccatcaacacttgctgggcaataatccaaactgttatgcagaatgatgtgataaaagggatcagagagaagtgctgtgaggaatggggatgagttcactgggatgatgtcagagaggcaggcgagggccagatcttgctgagctacggaaagaaatggcacatttgatttgtgatttcaaataatccctttcactgctatgggaaaactggattgtaagtggcacgagagcagatgcagggagtcccagcaggtcggacactggttcagtgttctaggtgggtggtgatagaaggtgtgcacttgaatagtggcaatggagatgaaggcaagcgctagactgagaaacagaagcaaatggacagggtaccaaagtggataacatgtggtccctgaccttaaagagctaataacctacttgatgagaaaaagatgtacagacacagccatggtttggagagatatgtttttaaaataaggccatacacaaaatactaaaaaaaaaaaaaaaaatccaaaaaagagctgtgaactttgtctgagagtatctggataatttcagggaggaggtgatatttgaggtggacttccaatgtgtcatgtcaaatagcaccaagctgataagcaagaaccatcttaatcagattgactgggtgccacaaagccacacctatgatggacacacaggaaagtctagcagccaagcagagggaggatgactttccacaaagacaagtatttgtgctgtaagactacatgctttgacccatctgcaaaatgggtgcatctgcaagaaggaggccaccaggcaataggctgggggccaggtaggtacttcttgagtagtgtcacacactattcaaggagatctgtgactcagtatacccaagagaacctccaatttgccgccattctgccaaagggatgctagaggtttgaggaaagcagtctggcaaagataaatcctcagaattgaaagacctaaaagcacagaaccatccgtgtccccaactaactcggtgatttctttgctcttcagtttccacaaaaataaaatattatttatataacatatgcagatatatgcaccaagatacaaggcatgccatagactctcaaatatttgttgaacagataaaggaacatttaacacaacatttttataattgtaaaaactttgagactacccaaaggcctttagtaggccaataattaaataaacactggtatattcatatcttggactattacgtagctatgcaaaattttctcattagaaaaattcattattaatatgtgggaaaaacgtggaaaacacggaaagatgcaagaataaaataaaacacatcccctagagataacctctattaatattttgtagtctctgcttccatcctgtgtggtacttttgtagtgcatgggcattgtgtacctatgtgtttttagctaacataaatgaaattatattaaacatatgaattcaaattctgcttttttccctttaatattgttttatggtgttttgtttgttttgagacagagtcttgctctgtcaccaggctggagtgcagtggtgtgatctcagctcactgcagcccctgcctcatgagttcaagcaattcccctgcctcagcctcccaagtagctagaattacaggcaagtgccaccatgcccggctaattttttcttttagtagagacagggtttcaccatgttggccaagatggtctcgatctcctgacctcaggtgatccacccgactcggcctcccaaagtgctaggatcacaggcatgagccaccgtgcctggcctacagtgtttttctatataaatttttacaaagaggtttagcaatgtaaaaaaattgcattgattttataagaatggaaacatggaatacaaaatcatgtatctggcatgagtttaagtacgtaagtatttcgtatagacagacatgtgtgttttgtatacgtctgtatgaatgaccgtaagaaaatatacccaaggttagtaatgattgtcttggggttgtgggattattatgggctgtcatttcatcacttatatttttctgcatcttctttataacataaaataagcatgtattactactgcaataagtaaaaagagaaatgttttttgaacaggagcaatgaatttgaaagaatccaaggacgagtgtattaaccaactgtgatatctacgactgtggtttcacaaattaggggcatacttgcagcgccaggctcacctcgacctcctagagttatgcctcctcctcaggccaggccttagaggtcatgagacaggctgaggaaagagaggtccaggccagcatccatggaatctgtcccattagctcagagacaacaaaaaggggacagatccagagggtggggggactggcaatgcaggacacaggaaaagctagactaaaagatcccgggcaccgggagatcaaagggccaaagcgagcagcagccagccctcagaccaaagactccccaacacgccccacacagcaggaattcaagaaattccaaagcctaactctgaggatgtgctcaaaccctcacattattgaccatgatggcaagaaaagtcttcagtatcattttcgttatagaagttagcggagaagcaggcagtggaaacccaccatggtgatcagacagggccctttgtttgcatgagcttaattattgacttagaaaacttgagcatcctcctttgccagagaaagaagcacctttttttttttttttgaaatggagtctccctctattgcccaggctggagtacagtggcatgatctctgctcacggcaacctctgcctccggggttcaagcaattctcctgcctcagcctcacaagtagctgagaatgcaaccatgcaccaccacgccgggctaatttttttgtaattttagtacagacaggatttcaccatgttggccaggctggtctcaaactcctgacctcaagtgatctgcctgcctcggcctcccaaagtgctgggattacaggcatgagccaccaagcccgggcagaaagaccaattctttcaccatggcattcaaggcttccctgggtctgtctccatcaaccaacctacctacacacacacacacacacacacacacacacacacacacacaactattgtccatacctgccaagactttgttcatcctgtttcctctgcctggaaggcctttctctcatttccacgtatctaaattctttacaactccaaagtcctcttcttaaaaagcctttggaaaaaactattgagtgaataaagcaagggtctgctccagtcctgtctgagtgaatcagacaggtctgctccagtccaggcccctctccttactggctgtgtgacgttggacacgttcaatcgtccttctgataccaattttctaattagtaaaattagcttctaattgaagctgcctccaaggctttctgtaagaattaaaggagaaaattatttcagatatctatttaaaagtagccgaatttatgtcaataaatggcaacaaatataaattttatatcctctttcctagtatcagttccccacttcattttctaggtggcattttgcctacgggttcaccatcttctgtccaagtttacttttatgcctcctggagtcaaaggcaactgccgcctctgagtttagacacaattgggttgcatcttagctctggtaccttctagctgtgtgtttttgaacaaatcatcacacctctcagagcctcagcttccccatgtgaaaaatgggtttaatgtttcacgttggggagttgagtgagtcaatgtacattaagctcttggaacggggcctggcacacagccctagaagggttcgttgttactgcctcacagggttatggtaaagatggggtgggtttctgtttgtctgcaaagcccttatccaaagtcccaacacgtagcaagccctctgtaaatatcagtcgtataatcaggaatttagtaaacaagtccaatgcccctcactccacccccgcagcaatgtaatagatgtcagtcaatcccttttttgggtcttttcagaacaaaaacccctgttctctcctccagtggggtctccctgggctaactgaaccatcctcctggtcttaaacaggaggattcctggagccaagtgggatccttctcctgcaccacgagggcccaggggccaggtaacatactgtctggctaatctggagccaagcagaaactggcacagaggacatccacaggcttactgcatttccttcccctgtaaaagaaccctacggtccagcccagcaagcacctctctttgaccagctaataaggttataaaaaaacttatgtatctgactttaataatggtattaaacccagtaatctgactttaatagtggtatgccaaggcaaacatggtcctagcagggaccaggagcgagggcaggtgagggtacacatctgaggctgagcgacacctcctatatgaagttgattcatgttggagcaaatccgggcagggaccagctgattcaggcagttaagttattgctctgccagtttaatatttcgccatctgctaactgaaggctctactgcctgctgggtcctataaagacttttatttattatactacacatggcaacatctgccaccaggatgaggctctactcggcgccctaattaaacaaacacacacttcagtgacagcagagggccgggtctcgctgtgagccgaactgttgctgggagttaaaaacttggagtgtcccatcctgaagagcctttgctgagaaaaggtagcatgagtcattcacctcctggtggccactaaagatttacaggtgatttaaagcaggctggaaaaaaaaaattaaaaggctgggtgtttatctcccctaacctgcctctcactcccaaacagaacttgagtttcagggcttggtttggccaacggtcagaattcctgcttcacactgtcacatgagcccctgcccttcaatctccgtgcacactctcagaaacaagccctgcagatgaagaaaatgaatgtcaaagtttccattcaatttttcattcatgcatgcattaaaaaaatatggagtcattctactataaagacacacgcccacgtaagtttattgcggcactggtcacaacagtaaagacttggaaccaacccaaatgcccatcagtgatagactggataaagaaatgtgacacatatacactatggaatactatgcagctataaaaatggaggaattcatgtcctttgcagggacatggatgaagctggaaaccatcattctcaacaaactaacacaagaacagaagaccaaataccacatgttctcactcacaagtgggaactgaacaatgagaacacatggacacagggaggggaacatcacacaccagggcctgttggtggggtggggggctggggagggagagcattaggagaaatacttactgtagttgataggtgcagcaaaccaccatggcacgtatatacctacgtaacaaacctgcacgttctgcacacgtaccccagaacttaaagtataattaataaatgaataaagaaggagtatgtgctacataacccgtactctagcaggtgagctggtaaataagatagacatttgtgtcttcataaaagccccatttgactaagtcaagaggacacataaatggataagataattgcagatcgtgctgagtgttaggcagcaaataaagagggcgatatatatattagatactgggctggcatacaggtatattagtttcttattgttgctggaacaagttaccacaaatttagtggcttaaaacaatacaaacgtattatcttacagttctgtacttcagaagtccaacatgggctaaaattactgagctaaaatcaaggcactgggcaaagatcaagatgtcagcagggctgctccttctggaagctctagagaacatccattttcttgctttttccagcttctaaaggctgcctgctttctttggcttgtggccccttcctccatcttcaagggcagtaacatacctgtttccgtcatcacactcctacctttgactcttcgattctgcctctctcttccacttttaaagatctttatgattcctttgggtccaaccagatattccaggaatagctccctaaggtcagctgattagtaaacttaatttcgcctgctgccttaattgccctttgccatgtcacttaacatactcttgggttccagggatgaggatgaatttcaaagttcccattcaatttttcattcatatatgcattcaataaatattgagtatgtgctacataatccatactgtagcaggtgagctggtaaataagacagatgtttctgtcttcataaaaaccacatctttgcggggtgtcattattctgctgaacacagtggacaagaaactactttagatagcgtggtcctcaggagggcttctctgaaatgtgatcatgagaaagggttgcaagcagaaggaaaaggaagtatgaagatccagaggcaggagagaatttagaatggctttggtactgaagggaaactagtcatgggcttaggagtcagagagtcatgggcaagggaaaagtggccccagatgaagctgaaggggtgaaaaagggaggaatcagatcacctagagtcttgtgtgccttgcagaggcagcttggtgcaatgatcaaaagcccagacattggaagggaacttactttcacttaacacctaatttttaccagaccctgtgccaggacctttaaatagattatctcatttagttcctggaacaagtacatgaaatatgcattgcaattcccattttgcagatgagaaagtagtgacttaaacaactaaattataaagacacactgatgtgaattctgaaatatctggctcagagcccttgctttctccaccactcaaggctcctgtccaaatgattttgccttccgtgcatgtgtgattatgcagccaggatcctctatcttcttttttctcatttaacttgatagacagactgcagaacctcaaaatcacctgcagtggagtgtcccactgaatttgtgttttgcttaccgctttatcaagaggtacatgaaattcctcttgcctgctctaaagaggttggatcatcagtgagactgaacctataagctctccagtcccactagggaggatgcatgttatttaggacaccagctgagttgctggtacaagagatccaaaaacacagtgactcaggccaagtaggaatctacttctctttcacagattggtccagaggtacatagtctagggctgccatagtttctttgccccttgcaatcagtcatctagggatctggttccttgcattttaatgttcttctttcctctgaagtattgtcctcatccacatggttgaagtagacttgccagaactccgtcaaattccaacgtgtagaaagaggaaatagagaatgaaaggcaagtattttcctttccagtgctgtgacttgaagctgcacgcatccgttctgctcacaccctggaggcagtaatttagttgcgtgtccacacacagttgcaagagaagctaagaaaggtagtctctacctagatggtcacatacagagtgaaagcttgagaagttctactgctaacaaaatgaaagagaaaataaatactggagaaaaattagcactctgccacaaaggatgactgcccttttggtttatctaaagtccaggcattctttgcctgctggatatggtttgtagaatttttagaacgaataaatctctattgttcagaaaagagaaccaaattaatttcttttctctctcaggggctgaaagtaaaaatggcctgatcctgggtaggtctcattcacctgctgtcattggaaaaggcattggagttgtggggaccacggtgagtggataaacaaacctcatccagaacaggacctctaagaggggttaccgtgagagttaccagcctgcactacattgtagcccagcagcactggctccgtgttcaacagtgccatcttctctcagtaggaaacccaaacaggctgacaaataccagcgcttttccctaattgggagtacaagttgtgaggactcctaattatacaagaaccctggaactggagcagaaagtctcaataaggtaattcaggacttctggccaacctggaagctggtaactcaagtactcttgattaaatttggggaaaaataatttaaattcatgatagtacttgctcttgaggtattagtagaaatgctatttctgtcaataaacaaaagagtttttttaaaaataaaaaaaatcccctgaatatatcctcaaacgtgatgccaaagcaaagattgataaaatgccaaagatctggctaaaaaagatgcaaagaattcatggaagagccaatgtgacccactaaaaccactctaagtgcaatttttgaataaaatcccacttaaatgattgtttacctgaggtcaacggaggaccagggcagtcccaatgagtaagggacttaacatgggccacgggggtacatattgatgacaggaatcgcctgacaatcactaagctgatggcctgttctccatatgttcctcatctctccacctaaatttaatgtatccaactttttggaatccttcctcttagtcttgcattctgtacgtatatgaggaaggtaaggaactaggggttgcctaggagggatggagaaggataaatgcaaaaataacactgaagcgatggccttgcagccagatgacattttaggtagatccgcacaaatgcctacaaatgaaactccagggcctcaaatgcttcatctgtgaaatgggatgattacttgaatcaccgatataaattatgtgttctaggaacaaacggtggctcacgcctgtaatcccagcactttgggaggccaaggcagacggatcacctgaggtcaggggtttgagaccagcctggccaacatagtgaaaccccatctctactgaaaatacaaaaaaagttagccaggtgtggtggcaggcacctgtaatcccagctacttgggagggaggttgaggcaggagaatcacttgaacctgggaggcggaggttgcagtgacgtgagatcacaccactgcactccagcctgggtgacagagtgagactctgtctcaaaaaacaaacaaataaacaggagcaaaagcctaagctcagctttgtggctcaagaatagtgtccctgaggaggcagcatttgaggagggtgtagaaggaggggagggattttgatgggcagagacggtgtagaagtgtaggagaattgtgggaagtagattgtgtggaaggcctcccccagcttttatctcctcaacagtgaagtgggttacaagattattttgcaagttagaaataatgtttgtggaacacacaggacagtgtgtgacattaaaaaaataaatcaagtgattatgattaaattaacaactagtcactgactgtgacaaggttggggaatctgagactcctatgtaaggctagttattttgaaggaagacaatgctggtggtgtcttaggctcctaatggaggcaaatgaaaattctctctgtgtgaaagcattttctacttgggtcataagaatttccatagattaagatcaagcctctgtaagcttataatcaaaggccaccaaactcattaggaaataagccaccatgagggagaatcagcagaattaataaacaacaaatttttactcccacaaacttcagatactggaaccattgaaataatcagatacataatataaaatcattctgattaaaatatttaaatgaataaaagatggaattagaaaaatgggaaaataatcaacgtttataaaaaaattatgaggtatagttgaaaaatgatcaaataaaaattttggaaatcaaatatataactgttgaagtaaaaaactcaattcaactagccgggcctggggacgcaggcctataatcccagctactgaggaggctgaggcacaagaatcgcttgaacccaggaggtggaggttgcagtgagccaggatcatgccactgcactctagcttgggtgacagagtgagaatctgtctcaaaaatatatatataacaaaaaaatgaaaaatataataaaaactcaattcagattaaaaatagcaggaaagagaattagaacttgaagatatgtctaaagaaattatctagggtgcaacaacacaaatagattaggtgattaaaactattaaagagaagttaggagatacagaggacagaaagaaacagactaatgtatgtctaatatattagacatactattgggagagaatagagagactggataagaggcaatattaaaagtgataatagatagaaattttgcaaaggctgggcagggtggctcatgcctgtaatcccagcactttgggaggcagaagtgggtggatcacctgaggtcagaagtttgagaccagcctggccaacatggtgaaaccctgtctctaccaaaaatacaaaaattagcccgccacggtggcacatgcctgtagacccagctactcaggaggctgaggcaggagaatcgcttgaacccaggaggaggaggttgcagtgagccaagactgtgccattgcactccagcctggacgacagagtaagactctgtccgagagagaaaggagaggaggggaggggatggaaggggaggggaaaagaaatgttgtaaaaatggtaaaatacagtcacgtaccacataacattttggtcaacagactgcatacatcagtggctccacaaaattgtaatactgtatttttattggaccttttctatgtttagatatgtttaggcagacaaaggtttaccattgtgttccaactgcctatagtattcagtagagtaacatgctgtacagtcatgtagcctaggagccataggctataccatatagcctaggtgtgtaggaggctacactatctaggtttgtataaggacactatgatatgcacacaatgatgaaatcacctaatgactcatttctcagaacatatcccgattgttaagtgaggcatgatgagatagacagatagatagatcatcatatacactaacacacacataaaatcttcaggtccaagcacagcatatataagcaagatgaatgcaaagaaattcatagctagacatattgcagtgaaaccacagaacatcaaagacagagaagacttaaaagctcacaggggaaaggggcagataaccttcaaaaacactacatttagatcaccacctgagttttcaggcaaagcaatagaagccaaaagactctggaataacatctccaaaattctaaaagaaaacaaccatcattctagaattgcgcttcaggcaaatgtgtcttttaagaatgagtgtgaaatgatgacacttccatataaacaaaaactgagagatttttaccactgataaattcccactaaaagaatactaaaaaaaaaaaaaaaatagcccagaaaaaaaaatttcgagtgtaagaatagttagcaagtaagcttacaaactgagagataaatctaaaacattatctgtgtaaaatattaatagtaacaatctgatttgtgagaatttaagatgagattgaaactactgacaacattgacatttaagtaatggggaagtcattgacattaaagtatcataaagtccttatagtatttggaaggggaagttaagatatttatgggctttcaattttccttgatacacacaataaaatttcaagggagagatgatagaaaagaggttttaaatttttggaattttagaatttttagaatcttaatatttgaatttggaattttagaattccaacaagtaaagggaaaagcagagtttgaaaacaaaacaaaaacaaacaaaaaacctcaatttaaagaaaagaaagaaaagaagcatgaagaaaaatggaataaatcttagaaaccatatagtgtgaacaaagcaagtcttaaaatattatttaaggccaggcacagtgactcgcacctataatcccagcactttgggtggccaaggcaggcagatcacaaggtcaggagttcgagaccagcctgaccaacatggtgaaacctcgtctctactaaaaatacaaaaatcagccaggcatggtggcacatgcctataatcccagctactcaggaggctgaggcaggagaatcacttggacctgggaggtggaggttgcagtgagccaagatcgtgccactgcactccagcctgggcaacagaacaagactctgtctcaaaaaaaaaaaaattatttaaggtatgagaccatctttataaagctcaaaagcaagcaaaactgataaagctttgtggtaaagctaacaaagcaaagaaaggggatgataaacacaaaacaggattgtagatttccacatggggataggatgggggatgcaagaggcacttttcatccagatggatccagtagaactgttcattttagtcaatcagttaggcacttaatgtagtttggatatttgatcctcccaacatcgtgttgaaatctctccccatgttggaggtgggacctattgggaggtgtttggggcaggggagttgattgctcatgaatgacttgctgccattctcaaagaagtgagttctcattttgggctgggtgcagtggatcatgcctgtaatcccagcactttggcaggcagaggcgggaggatcacatgagaccaggagttccagaccagcctggccaacatgaagaacctctgcctccactaaaaatacaaaaattagcagggcgtggtggtaggcgcctatagtcccagctactcaggagactgaggcacaagaatcacttgaacctgcgaggtggagactgcagtgagccaagatcatgccactgccctccagcctgggcaacaaagggatatcctgtctcaaaaaaaaaaaagttctcattcttagtcccaggagaactagttgctgaaaagagcctggcatctcctcctctctctctcgcttcctctctcaccacgtcatctgtgcacacagtccctccacttccccttctgccctaagtggaaacagcttgaggccccaccagaagcagatgcagtgtcaggcttcttgtacagactgcagaaccatacaccaaataaaccgctttttaaaataaagtgcccagtctcaagtattcctttatagcacacaaatggactaagacagcaatgattttatgggtcttcattttgttgatatgtttgataacttacatgttatatatatattatttgtgtgtttcaaatattgcattaaaaatatttaaaaataggccaggcatggtggctcacgcctgtaatcacagtactttgggaggccgaggcaggtagatggcatgaggtcaggagttcaagaccaggctggccaacatggcgaaactccgtctttactaaaaatacaaaaaaaaaaaaaaaaaaaaattagccaggtgtgatggccagtgcccgtaatcccagctcctcaggaggctgaggcaggagaatggcctgaacccaggcagcagaggttgcagtgagccgagatcacgccagggcactccagcctgggcaacagagtgagactctgcctcagaaaaaaattaaaaataaaattaaatgcagaaaacaataggagggtaagtttcccgaggacaagagcaaaaccagagcttttctgtatcccatctactgtacacacagtgggccctcaacaaatatctgcttacattacagccagggaatttgtttactttagtgcattacaaaagaatgagaaaagccgagtcttctcaaaagcaaacgtcaacgcggcagacagaggactaaattacatgataacacagcatataatatagtataatgggcatgatacaggtaataataacagaaaaacaaatctgtttttcagccatgaattacactgtgtctgtggctttgggcaagaagcatgcctgtagttaccctgggctgcaagttgttaaatcatgatggatgatcccataaggaaccaaacaagatcagtggaattcattgatttgccgggtgccctgggaattctttcatttccccccagacctgactgcctcctcctattactggggcagcagttgggctataccacacagactagccatgaagcgggagagaggcccagaaatacaaagccagcattccaggtctagccacaaagattataaaataagcagctctctacatccaatccaaagcaacgagaaggtggttgggtggaggctggaaggacacactcaagaattaaaacttagatctgcaactgctggttttgtgtccgagagtggattattttgcctgcatacagctcagtttttgcattaggaaaataggaatcataatgtctaattcaaggattatttggaagacatctgcttgcaccagatctagcacatagtgggtgctctgcaaatgtctcctttcctcagtaagtttccacacatcttcacctctgaccttcaacttgtaaataaagcagagattgcaatgctgcgtgacagaggagaaaaatgctatctaaaactactactgactgcagctgcttctgtccctaagggagacacattatttctctccagactaaatatattttcttttgcaaaatactttgataggcagctttggttatgaaatgtgaggccccccagggcacagtttagaagaagacagtgaaacaaagaagtagtgaaatagctctgcgttgtaaaaatgaacagagatgccagggtttggcggtatgctaggaagcgcagtgataagagaaagcacattgcaacagcaatccctgttgctgttcttcacctgacagcccgtcctctcctcttccactactttatagctgtcattagaaattaatctggccgagcactgtggctctcacctgtagtcccagcactttgggaggccaaggcgggcagatgacaaggtcaagagatcaagaccatcctggccaacatgatgaaaccttgtctctactaaaaatagaaaaattagctgggtgtagtggtgtgtgcacctgtagtcccagctactcaggaggctgaggcaggagaatcgcttgaacccaagaggcagaggtcgcagtgagccgagattgcgctactgcactccagtctagcgacagagcgagactccgtctcaaaaaaaaaaaaaaagaaataaattatcttcaatctgaggaaaccaatttagaaaaagaaaaataaacaaaataaagaaattatcagcatcttacttactatatagtctacttattcactgtatgtctcttccctcaagaaaggaagtttcctaagggcagcatttatgtgtattttattcattgtcgtttctccagagcccagaagagtgcttggaaaataagaggtattcattatgtttttcttcaataaatgactaagaggggagttttaaagcaaaacttctactgccaaactgcagctcaatgagaatacaaaactattgttttaagtgtgagtttaggggttgtttgttatatggcattattgtagcaacagctgactaatacagatagcaatattggttgcattcagatatgatttaaatcacatcaaagttgcaagactgaggtttggggctcagattctcctgaatttaatcctgtcccattatatcagagcctctcttttctcctctgtagggaataaaccctccttctggagtgatgaaatgataaccttcttcacaggtcactgtgagaattaaaacaccacttttttcataaaaagcactcaataaatatcagtcattaccatctatctactcaaacaattctgatgtttaatgggttcacttattctccaggtaaagtcagtcctgctaaaaaatgaacataagattttgatcctgtacagtgcttgaagttaaaggtatgtaatatgaaataatattttttgaataaattagcaaagtcaaattaattataacacttaaagcttatgaagcaaaatggttatttgcactcattaaaaataggtataacttccttgtttttttgagatgtaatatgaccatattttattaagaaccataaaaaatctttagatattttgatcaatgtctaccttctagaatttatgttaaggaaattattgtaaatttttaaaaaaatattttgtgaatgcacatctttattgaagcatatttggttgcatactactttgaattcagaaatagaaagtcaacagaaaatgccattctcatgcaaataatcaaaacaaattagatgagctacaaagctatttggaaaaaaaaaaaccttcagtgaactaaggacagagaaaaatccaaatgaactaaattccacaaagtgaagatcattttagaggagaggagagatttactacaggtcttatcaaaagcatgctcttttggatgtaaatattttttactttagtctctactgttcttttatacagaattttcagtatacaatcaaacattagaagacatattaatatttttttaaagaacaacaaaaaagtggcctatagttaagagtagaaacaatcaagaaaaacagatccacagatgactcagatgttggaattattagacagggaatttaaaataactataataaaaatgccaaaagcctaacgaaaaatatagataacatgcatgaagaaatggaaaatttcctaaagacacgttcaccaggaaacattagaagaaaatcaaatgggataagtagcaatgaaaaatacagtattagaaatcaataacatcagatgtacttaacagcacactggaaaaaaaacagatgaaagcatcagggactaaaggcagatcaatagaaagtatccaaactgaaacacaaaaggcaaaaatagtggaaaaaatacaacagaatattcaagatctgttggacagtataaatgaatctaacatgatatcaagtgatgtaacagaagttccagaaagagaagagaaaaactggatcgataatatatttgatataataaccatctgagaacattccaaaatggatgaaagacataaacctgtagagccaagaagctcagtgaaccctaagcaagataaatataaagaaaaccttacctagctatgtaacaaccaaaaatcacataaaacaataaacagcaaatctaaaaagcaataggaataaaatgacacattaaatacattagaaaaaaatttatgatggctaacttttcatcagaatctagaataaaagccagaaaacaattaaatgacatcattgagtacgacaagaaaaaagaaatggaagcagagaattctatgtctagcaaaaaatatccttcaaaatgaagatgaaataaagatatccttagagagacaaaatctgagatacttgctgatacttcaggctgagggaaattatatcagatggaaccccagatgtgcagaaaggaattaaaaacaccagaaaaggtaaatatttgtataaatggaaaagaccttttttgacttttatttttacatttataatttctcaaatatttaagtgactatttacagtgtagactggaaataataacgtatgataggattaataccatatgtgtcactgtaacacagaatataacaagagcacaaaaggcaggattggacataagtggaattatactgcagcatgatttttatactgtgaattaggttaaacattgtttgaaggtatactgtgaacatttacatgtagtttctatagtaaccactaaattttttaaaaaggaaatataatctaactatccacagaggatataaaagtaatattaagaatacttaattttcccctgaaaagacaaaaatgaacaaaggaataaagaataaataccataaatataaaacaaataccaagatgggagacataagttgaatcatatcaataattaccttaaatgtaaatggactaactcctctaataaaaagtcagagcttagtaaattggatatgaaaggcaacacccaactataggttgtttttgagaaacacaattttattataaagatacaggccaatagaaagtaaaaggatagaaaaagatatagtatgaaaacaccaaaaataagaaatctggtatgactatgttaatatcagacaatgtagcatttaaacaaagagtatgactggatattaagaagaatacctcaaaataataaaaaaaggataattgagaagaaaacaatcatgaatatagacgtacctaacaacacatttccaaaactcacaaaggaaaaactgacagaactgaaaggagaaataaaaaaaaattcacaatcatagttggagaatgtaaaccctcttggtgcaggttgaacatcccttatccagaatgcttgagaccagaaggattttggatttttccggactttggaatatttgcattatacttactggttgagcattcctaatatgaaactccaaatccaatgagcatttactctgagcactcaaaaagttttagattttggagcattccagatttcagattttcaaattagggatgctcaacttataactgatagaacaagcagatcaaagattcagtaaacactatttgaacaactctgtaaaccaaactgacataatattttaaactactacatccaacagctgcagaaaactcattcttttaaagttgtcatggaacattcagcaaaatagaccatattctggatcatataaaagtattaatgaatatcaaagaatgaaatcatacagagtaacacgatagaataaaatcattcacagtaagatatctagcaaatcccctaagtattgggcaataaaacaaccctctcctaaataacccatagatcaaaaaagaaatcataaaggaaactgtaaaatattttgaactgaataatatgaaaatatatcaaaatttgtgaaataaagctaacgcagtgcttagaagaaaatttatgactttaaatacttacactggagaagaaaggtatatacaaccttccatcttaagaagctagaaaaagaagaagagggtaaacctaaagcaagtaaaagaaaggaaatactaatagtaaagtggcaatacaaagtcttaacaacaatggacaaaaaaaagagggaaagcacaaattgcccacataaataaaaatgaaacatcactacatattctaaaaaatgttaaaagggataaatattaaaacattctaacaattcaacaacttatattaattaatccaaatcacaaattactaacaactgaagacacagaaaataaataaccccatagctattaaagaaattaaatttgtaaaacctttctaaaaagaaaattttccacatatatggttcattagtaaattctacaaaacatgtaagggagaaatatcaatattgcacaaattcggaacatagaggaagaggtatcacttcccaatttaatatagaaggccagcatcaccctgaccccaaaatataacaaagctattacaagtaaaaaaataacagcctaatccctcatgaacataggcaaaaatttcttttttttttttttttttttttttgagacagaatttcactcttgttgcccaggtgggagcacagtggcacaatctcggctcactgtaacctctgccttccggtttcaagcgactctcctcactcagcctcccaagtagctgggattacaggcgcccaccaacacgcccagctaaattttgtatttttagtataaacggggtttcaccatgttggtcaggttggtctcaaactcctgacctcatgatctgccctctttggcctcccaaagtgctgggattacaggtgtgagccaccgcgcccagcccataggcacaaaaattctaaaccaaatatttgcaaacagaatccagctctctctctatatatatgtatacatatctatatatatatctatagatacatgtatatctatagatgtatatatatagatatatatagatacatatatctatagatacatttatatgtatctatagatatatatgcatacatacatataaagaataatacatcatgaccaagcaaggtttattccaagaaagcaaggttggtttaatgaaaatcaatcaatataattcatcatactataacagagtaagagggaaaaccatttgatcatttcaaaatacacagaaaaaaaatttgacagaaatcattatttctttatgataaaaacactcagtgaaactaggaatagatgggaacatctccaatatgataaggttcatctttaaaaacctacagttaatatcataattaataaaatattaaatctttttctcctaaaatctggaacaacaaaaggatgcccactctcatatgctgtgttcagtatttactgaagtttttagccagaacataaggcaaataaaagaaagaaaaggcacaaagttagaaaagaagtaaactgtcattatttacaaaaacataatttgtctaaaacctggaagcaaaactaatatccaaaaatagatcctttgactacatttcagggaatccatttaacagactattctgtagtcatttagaatgagattctattaacagtgctaataaaatggaaagtgtttgctaaaaccagctgtaaaaaacattttaggggaatggtggggaaacatggactggttattagacaattttaaagagttatttttctctttgttagaagtgatggtgctatgtggttatgtgaaattttgcattttaagaaacacattcttaatcatttagaccaaaggttttcaacctcagcactaccggcatttagaaccagataattctttgttttggagggggcagtcctgtgcattgtagtatgtttagtaacatccctgatctctaccagggatgcaggcatgctttcttttgtgacaaccaacattgtctccagacagtgccaaaagtcctcttgcggaggacaagggtcaaaatcaccctcagttgagagccactgatttagggtttaatatcatgatgtctgtactttcttttgaaccacttaagaaaaaaaatgcacaaagaaaatataatattagtgttaattctaagcgataaatacatgggtgtgtattatgctatctttttttattctaccttttacttaggtattttgtttacatacttgttatatatataattttttttagatggagtcttgctctgttgcccaggctggagtgcagtggcatgatcttggctcactgcaacctctacctcccaggttcaagtgattcccctgcctcagcctcttgagtagatgggattacaggcacccaccaccaaacccagctaattttttttatttttagtagagatagcgtttcaccatgttgaccaggctggtctcgaacccctgacttcaagtgatctgcctgcctcagcctcccaaagtgctgggattaaaggcatgaggcaccacacccagccgacatacttgttatatatatactttttattttattttattatactatctacttttctgtttgaaagtttcataataaaagtcaaaataattataatatgctataaatggaaaatgcaatacaattgtatggcactacgattaaaagtatacctaatgctaaatgacgagttaatgggtgcagcacaccaacatggcacatgtatacatacgtaactaacctgcacgttgtgcacgtgtaccctaaaacttaaagtataataataaaaaaaatgaaaaaaatatgcaaaattacatatacaaaaactactcaaaggagtatgttcaagaggagtaagtcttttcagcagtgtgccccagccactccagcgacagtggggatcaatgtaggttggctgtgccacagccacctgaattcactatgatcattaatcctctcctcccatcttttgtgctttaccagctgtataatgaatcctaggataaagtagaaacaaggaggaatcaaagagaatgtaaagaacagtttctccccaagaagaactctgaagatgattcatccttccaagccagatctcttgtcggaaaaaaaaaaaaaaaaagtgactggcccaaagcatatccaagaggaagcattggaatgaccagttgacagccaggacttcccactctagagttgtcattgtcccagaatagagtgacaattaaaatcttggaggagtcacccaagaagcatttgatcttaggattaaatgaaatttatcccctcaatattggagagaagtagcagaacaaaggaacaccctctatgaaacacttaaggaaaatgagaagcttcacagagaaattgaagaaagaacaatgaaattgaccacttggaaaaggagagtaaacaactggcaaaagcggcagagtacagtatatgacagaggcaacccagagactgaatgatgaacctctggataactctgaagcaccagatagtcaggaatttgattctgaagagaaaactggtgaagattctcaagtggaaaacccaaaaattggcacatgcactgagaatcctgtcttcctctacagatgcaaaaccttgcatgtaaaatttaggattcacaattgtcgagatatgaaaccaacctaagtgcccatcgaccaatgagtggataaagaaaatgtgtggtacatatacaccatggaatactactcagccatgaaaaaataatgatataataatgtcattgcagcaacttggatggagctggaggccattattctaagtgaaataactcaggaatggaaaaccaaataccatatatgctcacttataagtgggaactaagccataggtacataaaggcatacagagtgatataatggacactggagactcagaagaggagaggatgaaaagggaatgaaggatacaaaaactacatattgggtacagtgtacactactcaggtgacaggtactaaaatcttagactttaccactatataatttataattcatccatgtaaccaaaaaccacttgaaccccaaaagctattgaaatatatgtatatgtaaacacacacacacacatatgtaagtcttacatgttaaacctattaatatttgactcttgagaaatataccatccagtgggttcacctggccccctgcctagacagagccaatttagcaagatgggggaactgcagtggaaaaacagtaattcacacggagccacgtgtgcgggagacctgagttttattattattcaaatcagccttcctggagcatttggggatcagagtttttagagataatttggtgggtagcggctcaggaagtggtgctgattggtcaggttggagatggtatcatagggggtcgaagtgaggttttcttgtggtcttctgttcctgggtgggatggcagaactgggagccaagttaccagtctgggtggtgtcagctgatccactgagtgcagggtttgcaaaatatctcaagcactgatcttaagttttacaataatgacgctatccctaggagcaatctggggaggttcagactcttggagtcaggggctgcatgacccctaaaccataatttccaatcttgtagccaatttgttagtcctacaaaggcagactggtcaccaggcaagaaggaggtcttttcaggaaagggctattaacaattttgtttcagagtcaaactgtaaactaaattccttcccaaggttattttggcctatgcccaggaatgaatagggatagctttaagattagatgcaaggtgtagttggttaggtctgatctctttcactgtcataatttcctcagttataatttctgcaaaggcagtttcaagtttacctccagtatagttctttaaagcagaacacataactacataatgcaacctctgagatcaaaattctttgtttgaatcctgggaccctattgtattaaaatacaaacactgtatatttttaatttatgatgttttatgtgaacagcattttctcaattgtcagacatgacttgtgtaaatgactaaagaaacttcaatctcctattgaaaaaaaaaagaaatatattcaaggggttgtggatgagtctgagtgtaattcatggttgatttcacttcctggatgttaaagtaatctgtaattatctgcttttatattgaaaaaaattgacaaaatctaacagtgtcaaaatgcaatattattaatcattcatggcctaatattagaagagaattagcagaaaacacagcagagaagagagacttgcagactggaggtcttccatccactacgaagaaagcatctagaggcggaatagctttgaatgggcatacatctgcataatgacttttcctttgttcttttctcactggctaattgagtaactcctacaacaaatatgccttcagacttcacaccagattagagccctttgtaaataaaattaaagttgggaatatgctttccctagctggtaaataaattcaggaagtctgaggtttagcactgcatgccaagatgtctaagtaaatctcaaattcttccatattttgaaataaacaccaaggattatcaaatgccaagaactcccaagaagaaaatagctcacctcactctctgaatcagagaccctctccaatcaaaatgtcccacctgaaaagtagtcttctctcctaccccatcacagacatatggatgttactgatgtcatgtgtgtctggaatattgcctggttcctatgacaagaacaataaaatctcttagtattctgcggcaaacagtctctttctcatttatccacctctgcattgaacatgagtccctcctatgggcccaggcattcttctaatcattggcatcacaatagtgaaccaaacaaaaatgctggtcctcagagagcttagtttttagagggttcttccaaaatcctagcagtggtgaccacaagcagaggatagatcctgggtaaccagagtcaggttatgcaatgcttgtgttcatcatgtcaggataaaaatcttcatctgatttcagactcaccacacggcatcgtcataaggtcataagtcatggactatttgagaaagcactaagctaagaggagaaaaagtgcccttgaacctttctgaacccaatggtatctgcctaagagatggggaagctgaactaggtcacactgagatgagaagggggctccacccatgatgtccttgtctcagaataagtcagcctcttatgctataatatgtggatcaaaagaacaggatgggctgggcgcagtggctcacgcctgtaatcccagcactttgggaggctgaggtgggtggatgacctgtggtcaggaatttgagaccaacctggccaacatggtgaaaccccatctctactaaaaatacaaaaaattagccaggcatggtggtgggtgcctgtaatcccggccactccagaggctgaggcaggagaactgcttgaacctgggagagggaggttgcagtgagccgagattgtgccactgtactccagactgggcaacaagagcaaaactccatctccaaaaaaaaaaaaaaaagaaaagaacaggatgtgggatcagaggagccctccaagacaagtggcttcagttcaaatataagctctgtcgtttgttcagtgtttcaccagacaaagtacttgagtgtcctgcttcagtttccccatctgtaagctgaggtgagcaagaatacttcacagagttgttatgagagataagtggaatgtttcatgggaggcagtaagcacagtgcgtgccacatagtaaacactcaataaatgttagctatttccactaatacagtatagtatatataatataataatgttagctagttatgagtcattatgaacttagttactcacccaaaggccccagttatatcctgaatgcacaccatgtgccaggcatcatgctaactgctgtttatattttcttctttacttcctccagcagcctataatggaagttatcatggtctttattttacaggtgaggatactgagctcagagatgtgaagcaacctgcccaaggtcatgcacccaggagtggcagggtcaagatgcaaacccaggcagaaattactcgaaattccatgttctcttcccaacacaatctctgtcttatttctgtctttccaatgacaccagtatttccaaactttcaccttaccacattctttaagcaacacattatgcagatttcttttttaactggcaacctgaggcaggtctctcttaaccgctgtcagcctaagctcactgctaaagcaccatctctatgtgcccccagacctttgagcactgtcaaaatcagaaatgcattcaccctgtaactcagcaattctacttttggaaatttatcctagaatatacgtacacctgtacacaatgacatacatgcaatgttattcatcgcattgtggtttgtaatagcaaaagatgagaactttcccaattgttcatcaagagagaaataattaaataagacataatatagccattataatagaaaaacatataattataagtaagaatgaaagaactcactataccctgatacagaaagataagcaggatataagttttaaaaggcaggatacagaactgtgtaataaaaaaaaaagaagtgcatatacatttgtatttgcttgtacatacctgaaattctgcaaagataaagaagaaacacataacaatggctgtctgtgaaaaggaaatgttccaggcagaagggacaattttcactgactattctagcatactcttgtttttaaatttttcaatcatatgaatgaccggcctgttcaagaaatgaaacaattttgaaaatacgggttttaagagtataggattaagagtataggattttttttaagagtataggattaagaatcagaaatttgagtccaagttcggggcaaacttggataccttactttatttctatcagccttcatttcttcattagcaaaatctccaagtccctaaatactggggactttggccaacgttatcatagctaccatttattaagtggttacttttgccaagccctatactggagcctcctaagaatttgcctcattgagtcatcgcaagcaaccctatgagataggaactatgattactcccatctcacagatgagcaaactgaagctcagtgcgggggtataacttgcccaaggtcacacagccagtatgtggcagaaccagaattcaaacccaggtctctcaagcctgtatttggactcaatggtttgctgcctccatccacattgacagttttcctagttgtgttccctgcctcttgcataaatcccacccaccagttcccttctgaaattgccagcctccaccaggcctggcccttgctcatttccaatcaccctttatccaccatagctttggaaatggactgttactaatggctagtcatatgtcagcctaatgaatgggaggcagacttccattaaaataatgaaattagcgagttttgaatttggttacatcgcatggcacacagcctcaagtaatgaccaccccatgctccttcctacaaattaaagtcagtttatttatttaaggtctttggcttggccatctctattaagctcacatcatctgtttagggatggatttttttttttttttttttggccttgtttgtttaaatgatgttcgggctgttcccctgattaataaagtcgtaaacacagtcaggagcagcttctgaaccatgtgcaaaagcaaagaatgtaagtcaaagaacaattctttgggggtttgggttttgtttgtttggggtgtttttttttcctccaaaggatggaaacaataagaaagaagctctttgagctccagaaactccaattatgctgacatttctgctgcagaaatacaccaagctccattttgcaggaacccagtgaactagctaatcagatttccttggataatttgctccaaaggtcagctgccttaaaaagcacccagtgcctcattatttggtaaagcaggctgcatgcgggctgcgatttggaactcagcctcccatggcaaggtagtttttctggaattttttagcccagaccctgcagccttagctttggccaaagtctcatccacctttgtgatcagcccgcagacaaaatcattaccagaaaaagcacctgaatctctgagtctgtgaggtctctgtctccaagacaggtctctctcgtgtcccaggagcaccaaagatggcagactcatctgaaatgttcatgccattggtcaatttcaagggaggcttttactgatactgtgatgggtaggcggccagacctaggttctaatcaccaagtccaattctacaaaatccctaaccagtacccctcaaaactatcaagatcatgaaaaataaggaaagatggagaaattgttccataccagaagagactacagagacgtgagaataaatgcaacatgaaactctggattgaatcctggacaggaaaaagacattagtagaaaaactggtgaaattcaaataaaatttggaatgcaattaatagtttccaaagttgtgacaaagacattaacatttttttaacattaaagaagctgggcacaatggctgacacctgtaatcccagcactttgggaggccgaggtgggcagatcacgaggtcagaagttcaagaccagcctggtggtcttgaccaccaacatggtgaaacctcgtctctactaaaaataaaaaaattagctgtgaggtgacgtgtgcctgtagtgccagctacttagggggctgaggcaggagaattactagaaccaaggaggtggaggttgcagtgagccgagatcgtgccaccacactccagcctggtgatcgaacgagattccgtctcaacaacaacaacaaaatttaagaaaaactgaaactgagaagggatttcttggaacttgctatagtatcgttgtaacttttctataaatctaaaattatttcaaattttaaatatctgtatataccattaaaaaatccattgtgtattagttatagtttgatgaaaataagtttaaataatacataattattgttctattataaacttgatatcctagtcctgatatgatatcatagtcttgacatgtgatatcatagtctaaaaacaaaacaacaagaccagagaggaaggtaaagccattcctacaactgaatttttattcaatctcttttaagatcccagcaaagaaaaaaagaaacaacaaaaagtaggactttggttaagctaaaataaaatatgatggatagtctctctctataaactgacacaggaaaatccaagacaaagaaactaggttttgtttgtttgtttgtttgtttttaccactcccaccaacctcaccactctgaaggattgtaatatcacaagaatagcttacaaagcaaacatcactggcttagcttccactctcacagatttttaagacacccagctccaatcctcaccctctgatccttctcatcttgtagaaagagatgcatgaagagtccattgtgaaccaggcattgtgcttgatgacggagacaccaagtcaacttggaccaggtccttccccttaaggagtcttggaaaatttgctcaagagagtctcagctgaatctcgaaggaagaagaggaggtagttggatgaagaaagaaaggaggcttccagaaaaagagcacagtgcatgccaggacatctaaatcatgacacttagatacctgcataaagaggacaaaattgaggtgggaggagttagaaagggcccccaggtaatggccttgtgtggtaaaggatttaactttctcctgaaggagataaggagttttaagcaagcattttagaaagattcagcagaggacagtggatagagggtgaggccaaaagcaggaagactatcatccaggccacacatttctgaatacaatgcccagagacagtgggagagatttctccaaggattctttgcaggaaacaagggtccctgcaatgatgagacctgagtttcctatttctctagtagctttgtagctcagcacccatcccaactgcagctggaagatgtcctctgctatttctccattccatactccaagtccctgccctgcagtatgtatgtaccttttgccacccaccctctgactctgttacattgtatattgaatcttcaacctaaagatctcaactgcttacaaaaaagaagagaattatgtgggcttaataatgttaagggcagttaccacatgagcactgactatatccaagcattgtgttagcctttaacctgcaaagaaaaatacaattatccccatctcagaacataagaggaaaattgagactcccaagaagttaaataacctcctatatagcttttaacatgggtggggataggatatggatttgagaatgtctgattccaaccacccttttatggcacctcactggctcacttttaatttcacttgctgatttattacaaatctccctctccttcagaatcaaacacaaactcattatgctgggccaaaataaaatctgaatggccatacccaattgtttttaaaatgttcagccttccctgacagatgtatgacattgcaacactacagctttggagtggctggcttaacgccaaggagtggttccaaatctcttttccagtggaacagtagcacaaatttggtctaccatctaaaaccaaataatggctgcccttttcctcttcctggaaaaaaatgacatagatgggtaaatggattaatgaatggattagacggataaatggatggatgagtgaatagatggatggatggataaatggatgtgtgtgtggatggatagatggatggataaatgggtaagtaaatgaatagatggataaatggatgaatggatggatgaatgaatggatagatgaatgcaaagtggatggatagatggatggataagtggatgaaagaatggatagattaatggaaagtaaatagatagatggatggataaatggatgaatggatggatgggtaaatagatgaataaattgatggatgcataaatggatccatctatggataggtggctagataataaatggatgggtagatgaataaatggatagatgggtgaataaatgaatacatgaatatacatttacaatatagaatatttctcaaggggaacatagaaaactatcaatagtggttgccatttctgtgaagaaacaaactggttaggacaaggatgggagtggaaactaccttttactatacactcttttgtatctttccaattttgagccatacgtgtataatacctatttttaaaataaatagcaatataaaactaatttcaaatacttttgttaaatgtatatatgaatgggtggacagaagaataaataagtcctaagtttttaaacaaataagattcaactgttattttccccactgatttttctttaaatctcggcactaacttctacttccctacataagaacataatgtaatgcgtatccaccttagtgcacaatcaactacaaaatttggttattcaaatggaatatgtcaataacattgtgttgctttgcaaagagcaccttgacttcaaggtgtgtccgcttacgtctgttcaaggacctctctgcaggagttagagtaagggacaacagtgctgaggcctggacacatgatcccacccaagtttctttttctgttgttggtttttattttgttttgtttttttgagacagggtctcaccctatcacctagactggagtacagtggcacaatctcggctcactttagtatccacctttcggactcaggcaattttcccatttcagcctcccgagtagctgggactacaggcatgcaccaccatccctggctaattttttgtagagatggggtctcatcaggttgcccaggctggtctcagactcctggactcaagcgatctggcctgccttgacctacccaaagtgctgggattacaggtgtgagccaccacacttagccaagtttctttaagccataattctcctctgtgcaagacctgcatactgggcttctgaacactgccccctgcaccatttggggaacataaggaagggctatgagtaaggagaccttgccaagggaaagattaaaaaacaaacaacttccccagccaccatcaatagcatttccaggaagaaataaacagaacggactcttggccataaaggatttatcactttcctttccattggtgtggaaatgaagcagggttgcttcaaaactgcattttccagctttccaaggagctgtgtggattccatatcctagagaagtcgacaccgttctagtaagttggcatggaccccaggtcctacccttaagggcttaatactctgatgcaatatataaaatataatttaataaaagactgaggcagtatttgtgtaccaagtgtctatagcaagtaccaaggtatttgcatggattgggggtggtagcaagtgtgtgatattctccttctaaatcccctgcgtgtggggatggaatttttaacagtgggcgatgtgataggacgatcagagatatgcaaaaccacctttttagtggtgggacacagtcacagttgtattccttctgggactatttggaaatcacacatttctcatcaagtaagaaaatgaaaacagagaaaaaccagttgacagtgatggctcaatagcgccatctcgtggtgatctctgtccccactccaagagcagtccatgggccccaccccttccgggatgttttgccccctctgtatctgagtcccagaaggcagtgcaaaagggatctgggcaaaacagagtatcctacagattggaacagtgaccaacggcatctttaaggaggagaaatttgaaatgggttctaaaggaatagatacccaggcatcaaagagaagcaaagacatttttgatgaagggcatagtgcaaaccaaggttggtggctggaaaatgtcagatcctttgaggatatgaggctggaaagtcagtctgggttggtgaggactcactgctgggctgctgtgggcatgagatgtccttggggaggtacagactttctgcgagacagaaagtcaaaaatcatctccattcacctgtggaccagcaccgtgctaaattacatcacatacatcagtttatgtatgcataaacatacatcagtttatctgccctcaaggggtgatactattatgaacctccacttgacagatcaagaaagcaaggcccaaagaagttaaatcgcttacctgaagtgacttagctaacaagcggcagagccaggatttgaaccaagatctctgcccaacttcaaagcatggtcttgctcttcataaaggtgttctcatctgcaggtctctgctgttgcttgtggcaaagacagttgtcacatatgaaattgctcaatccaaagtgcttctgctttaaatctaaatagttaccaaacattctgccccctgtaaagctgaagtttctcccgaaggcttcaggcttgtgccctaggacttcttgccacctggccagctggtcacagtgtctttgaatgactgggggacagatgtggcaaaatggtaaagtgtgacggttaatttcatgtgtcaacttgactgagctaaaggatgcccagatagctggtaaaacattacatccgggtgtgtgtgtctatgagggcatttctggaagagattagcattagaatctgtagactgagtaaagaagactaccctcagccaggtgcggtggctcacgcctgtaatcccagcactttgggaggccaaggtgggccgatcacgaggtcaggagatcgagaccatcctggctaacatggcgaaaccccatctctactaaaaatacaaaaaattagctgggcgtggtggcaggcacctgtagtcccagctactcgggaggctgaggcaggagaatggcgtgaacctgggaggcggagcttgcagtgagccgagatcatgccaccgcactcgggcctgggcaacactgcaagactccgtctcaaaaaaagaaaaaaagaagaccaccctcacccatgtgggcagacatcatcccatctgttgagagcccaaacagaacgaaaagcaaaggaagtgtacattttctatttgagctgggacattcaccttctcctgaccttggagatcagagctcctggttcttgggccttcagacttaccctgggacttaatgtcattggctttcctcataccccaccttgcagatggcagagcatggaacctagcctccataactgcatacaccaatccatataataaacagacatatatatcctactggttctatttctctagagaaccctaatacaggaaggttgtgaggtctgggatctaaatcccagctctgcccctgagttgttcaagcatagcctgtccaaagctgagttcccttgatctttttccccaaactcctcctcctctactaacccagccaccatcaacgctcctcctccaaccacacattccaccttgcccctcctggaacagagattcccacctcaggacctttgcactggctgttgcctccacctagaactgctttgccctccaatatcaacactgctccctcatgtccttcaagtctttgcataactgtcgccatctcaatgaggccaagcctggccaccaccaccaccccgaactgcacgccctacaccccgttaccttctctgtatttctcatagcagttgccaccttctacaatgccatgtaatttacttgttttgtttccggtttactgtgtgccttcccccactggtatcaatgtgccccagtgactggtagaacctaggtagtaactgaacacgtgttccctatgaaattggtttaactctgctgtatgtgtgaaattttttgtaataaaatattagggataatggtctcaaaggcagtcgttttatctgctttgttcactgatgtatcccaagtgtctgaaacaagacctggctcatagaaggtgcactataaacattactgaatggaggaattaaggagtacatgtgttacttagggcaagttatcttatctccctaaagctctaggtgtcaactacaaaggggcaaaatagtagctatttttcatttattaagtatttattgagcatctactatatatctagaactactatatatgtaggtactagagatacaactgtgtgaaagacagaccaagtcctccttctcatggagctttcaatccagatagggaaacatgaccacaatttcatgtaactccttcatttattacttattgagcatctactatatatctggaactatgtaggtagtagagatacaactgtgtgaaaggtagaccaagtcctcctcatggagctttcaatccagatagggaaacaagaccacaatttcatgtaactccaatgccatctatgagattgcctaatacctgtgtgtcccaactctgtcacagggattcagggaggaccactcagctgagtggcatcaaaactgagcactgaatcttaattgttaggattctgctaataagaaaaatgcatctttattttgctgagggcaacaatgtatccagctaaaaatcatctttcactagcatctcttgcagctagggctggccatctgacgtagttgtgaccagtgaaaagaagggagagcgcacctttagttttctgccttgctgccctcccttggcttctatgcctgctgacgtgatgcctggagatgaagcagctattttgtaaccatgaggatagaaattgcacagcagagcaagaaaatgaaaaaagtgggggtttctgatggtctctttgattcactctaccaacatggcttgcctactgtttagcttattgtgtaagccaaataaacccttgcaccttcaagccatgataatagagttttctgatacttacagccgtatctgttgtcccaagcaagatatgaacgaggttaagaggatgaaagtgaaatgtactaagcccagggcacagcatgtgcaaaggaccagaggtgtgagtgagcaaagtcaattccagcaacacaaagttcagggcagctgaagtggagtgggcaaaaagcaggtggtgagtgaagagtttgcaagagcaaacagggatcccactgaaatcaaggttttgtaaatcgaattggagaaacagtgaagagccatagcaagctgctaagaaaaatttgagttaatttatggaaagtgtccaatgcacagtgggtgcccaagatataagcaccgtgagtatcatcttaccttggaatacacacaaaattaactcctccgacaaaatgaagatgcatcacttttatctgcaagcccgccggaggtcacagacacgtgcagagggaaaacagtatggtgagacggagaaaaacaatccagccaggacagttacaccgacgctttattcatatctgccaccatcgggattgattcccacacagtgactcactcacagcaccaacctctttaatcaactgtgctgagcagtgacatccaagctcacctcggaaaacgacggaaactccaaggcaaggtggcctcccgaagtggccttttcccttccctcctcatccctgggctgtttccagcagacggcagtgaacgcctaaatgagggtttgatcaatggaggccaagctgatattgacaaagcagctgcagtttccgcaaatcacccagcactcatagatactgaagattaatctttacaaatacggggcaaagggggagagaaaaaaccaagtcgatttagtttccgattattactttctccagaaggcactgaagagtcaaaagtttaactgatgtacattagacagggagacaaatccagaaatatcacccaattacccggtagcttctagaaggtatttttcatgacagcaggtgggtttgccttttctaaatcaggaaggagacaagacaccgctaagaggatgttgacttggcccagcgcacaagcactaacctcaccggacaaatagaagcctgaaaatttgtcctcagtctacacggtccccatgaaaacacatttccaccgatttcctagttatttctgttttatgcctcatgtttagaaagtaaattgttccttcctggaacaagatggacttttttttaactacaaagaaataataaataagtgcttagcctccctaggcctccattttcacatccaaagagtgggtacagcccaggacgtaatgtttagagggcactgacaccatctagagtggatcattctctaccgtgcagggctattccgcccactgcaggatgtttactggcatccctgaagtctacgcaccagatgccagtagcaccatttcctcatccccagttgtgacaactgaaaatgtctccagacatgaccaaatgtccctgagagacaaaaccacttgcatagtcacgaacagataacacgactaagaatggggaaaacgtgaatcaaaagatgttccatgctgtgttcacataagcaataaaaccaaatgcttgaatttgatgctagttataacctttttattcatgtccatgtcacagccaaagaactgtttttgttttttaggttttttttttttgcagagacagcatttcatttatttcaggacactttcacagaagtattcatatattctggcaaaatgaaatcatatattacacaaacatttcatttccatagttagtacagaagaggaaaaattatttgtggtcaaaattactcctgagattcctttaaatcaaccataatttatagagtgcgcatgtacttgtgtatgtaatcattttaagtcataactatgcccctcgaacagttggaagtcactgagctggaccgaagaattcacaaaagagaaagctcttcacagatacttgggttttgaaaccattctgccattagatagctacctagtcctcaaggtgaactaagcacgatggaggaattccaagtgtggcttcccacctgcagggtcgactccactgagactctgctgctaacctcagcatacaaccctagatgatcttgtcgtgaagatgaaggagatcacagacaacatcttgccagggactgagttttaatgctggcgttttagttatcctgttgggctacaaaaacatgtcaggcaagatgttaagttttgtttaaagcatcaagaattccaggcccggcgcggtggctcacgactgtaatcccagcactttgcgaggcctaggcgggcggatcacgaggtcaagaggtcgagaccatcctggttaacacggtgaaaccccgtctctactaaatatacaaaaaatttgccgggcgtggtagcgggcgcctgtagtcccagctacttgggaggctgaggcaggaggatggcgtgaacccgggaggcggagcttgcagtgagcagagatcacgccactgcactccagcctgggtgacagagccagacttcgtttcaaaaaataataataataataaagaattccaaaatcaagtacaaaatcaaaaggcagattttcaaacaaaatctttgaaaagtggttctggccgggcacagtggctcacgactataatcccagcactttcggaggccaaagcgggcggatcacgaggtcaggagacggagaccaccctggctaacacggtgaaaccccgtctctagtaaaaatacaaaaaaaaaaaaaaaaaatcagcggggcgtggtggtgggcgcctgtagtcccaggtactcgggggaggctgaggcaggagaatggcgtgaccccgggaggcggagcttgcagtgagccgagatggcgccactgcactccagcctgggcgacagagcgagactccatctcaaaaaatatatataaataaaaataaaagtggttctgtcctgcttacaccctcttctcacgcttttcaggcacaaagaagggccaagagcaagagaggatttctttggagagagtctgttgaagacacgccttcatgttacaagatcttgaaactcatgggcaccatggtctgggatctgaatcctgcagcaaagctcttccaggcttcctgctatgctgcctggggtaactgcacaaggccccataattagacgaccccactgtgatgctggcattttgaaattcctataatttttttttttttttttttttgagacaaggtctttctctgtcacccaggctacaatgcagtggcatgaacatggctcactgcagcctcaacctcctaggctcaagcggtcctcctgccttagcctcccgagtaactaggaccacagatgtataccaccattcccggctgatttatttatttattttttttttaatttattcatttttttttttgtagagatgcagttttgccatgttgcccaggctggtctcaaactcctggactcaaagcaactccccagcctcagcctccaaaagtattgggattacaggtgtgagcccctgcacccagccagaattcctataattttcataacaagaatccccacattttcgttttgtgctgggccctgaaaactatgcagccagtcctgcccaggatgcttattttatttcattttcccagctttagaggggtaaaattgacaaataaaaatggaatacatttacagtgtacaatgtgatctttggagatatatgtatacacaaattgtgaaatgatcaccatgaaccagctaattaccctattcattacctcccatagttgtctttggatgtttatgtgatgagaacacctaagatctggtctcttagtgaaaggatggtgattaccagagcctgggaagggtagtgggctggggaatgtagggatggttaatgggtacaagaaaaatagttacaaagaatgagtaacacttactacttggtcaggtgtggtggctcacacctgtaagcccagctctttaggaggccaaggcggacagatcgcttaaggccaggatttcaagactagccgggcaacatggcaataccccatctctactaaaaatacaaaaaatagccaggcattgtggggcacacctgtagtcccagctactcaggaggctgaagtgggaggatcacttgagcccaggaagtcgaggctgcagtgagctgtcatcatgccactgcactctagcctgggtaacagaaatgagatcttcactccaaaaaaaaaaaaaagacctactacttgatagcacaacagagtgactatagtcaataatttaattgcactttttttttttttttttttttttgagacagagccttggtctgtcaccaggctggagtacagtggcgcgatctgggctcactgcaacctctgcctcctgggttcaagcaattctcctgcctcagcctcccgagtagctgggactacaggcatatgccaccatgcctggctcattttttgtatttttagtagagacggggtttcatcatgttggccgggatggtctcaaactctagacctcgtgatccacctgcttcggcctcccaaagtgtgaggattacaggcgtgagccaccacgcctggcctaattgtacattttaaaataactgaaagagtgtatttggattgcttgtaacacaaaggataaatatttgagggtatagataccccattcttcatgatgtgattattacacaccacatacctgtatcagaacatctcatgtacccgtaaatatatacatttattatatacccacaaaaagtaaaaaaaaaattttaagagctgctctcttaacaaatttcaagtaagcaatatggtattgttaaccatagttaccgtgccaaatatgagatgcccagaacttattcatcttatcaccgaaagtctgtaccctttgagcaacatttcctcctagcccctggcaaccattctaattcgactctcttttcctctgagttcaacattttcagattccacagataagtgagatcacacagcatttgtctttctctgtctgaattagttcacttagctaattctactctttttgtatgagttcaacgtttttaaattccacaaataagtgagatcacacagcatttgtctttctctaagtccacttagacaatcagaggtgcttgttttaaactcaggttcctggaccccactgtttttaacagttcagcttgatatccaagcctgtaagagacactttgattctctggattaaaatgagagacagtgagaggagaggaagaagaataaaggaggagagctttctctctaaaaatctaagggattccaattaaaaatcacctctcattgtacatgcagaaaatgtacagtgagacacaaagatgggttggaagacaaaactctgaaactagtctgggagggttaagtgacttcatggaaataaatactaaaatatcaaaatgctctaaactttccatttttacttctaaatgtgctgagaaaaaaatctgattatttgacaggaattttaaaaagaacaatttttataaaactaaaatcacattcctgaacactcaaatgcttagcataggggatgaaattgacctggaattttctttgtgagaggaaggaccaagttcccaatgtggatacgttaccagttagattttccaagcacagttcatactgcagaattcacctaacttgatttaggtttctcctttataatcagtttccacttgaacttcaactaccacgaaaaagtaagtaagtaaagcaaagatgtaaattcttgggaactttgttatgagaggaactttctagactgcacttagttgtcttatttaattagctaccagggaaacaaaacatatagtatgtccaaggagttgactcaatggaatgctgtcatgctaaacagatctaacgtcatgctgggtgagacacacagtctattttagaaagccaaacagggccggatgcgatagctcatgcctgtaatccccagcactttgggaggcctaggcgagtagattacctgaagtcaggagtttgagaccagcctgaccaacatggagaaaccccatctctactaaaaatacagaattagatgggcgtggcgacgcatgcctgtaatcccagcttcccagctactctggaggctgaagcaggagaatcacttgaacctgggagatggaggttgtggtgagccgagatcacgccattgcactccagcctgggcaacaagaacaaaactccatctcagaaaaaaagaaagaaagaaagcaaaacagaagcaaagcatgcaagaggtttattccaagcctctgacagtaggagtcctgaaatccacctggtggatgaaggaggagacaaaatttagaggacttggcagaatcacagaatgtggggagatgtttccaaagggggcctcatctcatgctgcaaacgttttgtctggagaataccaaaaaaaaaaaaaaaaaaaaaaagttttgtctgtgtcttgtgtcttgggttgttttgttgttgttgttttttaacgtcatcaatgaggcgttccttgttctgctgaggccctagaagcattcaggaaaggaaattcagaggtgggaactggagagaaataatgtgctcaataaaaggagtaaggttttggagccagacaagaaaaaaaatgagaagcagagctggggaaagaatagagggttctagaagcctgaatgtgccagaaaatcatcccctccagaatcccccagtcttcagtgaagccctatgaactcaatagctgagtaggtttcctgcaggcaatgggagacgcaaagttctgcacttaagctcctgtaggggaaaaagcagagccagcgtgggttgggggcaccagggccagaggcagatacgaccttgagaaggtcgccctccccagattagcaggaagtagcctgcatagaagatcttacctagatctttgaggattcaggggaccccagctgacatgtcggttattctacttaattataaaatgtttgagcagggcacagtgactcacacctgtaatcccaagcactttgagaggcggggacaggaggaatgcttcagcccaagagtttgagaccagcctgggcaacacagtgagactctgtctctacacactttatttttttttgttttttttttgtttgtttttttaaattagctaagtaggatgctacaggcctgtggttccagctacatgggaggctgaagtgggaggatcacttgagcccaggattttgaggctgcagtgagctatgactgtgccactgtactccagcctgggcaacagagtgagaccctgtctcacaaaataaaaataaaggccaggtgcgattgctcacacctgtaatcccagcactttgggaggctgaagtgggtggatcacttgagatcaggagttcaaaaccagcctggccaacatggtgaaaccccatctctataaaaatgcaaaaaattagccggcatgatggcaggtccctgtaatcccagctacttgggaggctgaggagggaaaatcacttgaacctgggaggcggaggttgcagggagccgagatcattccattgcactccagcctgggtgacagagtgagattccatctcaaaaaaaataaaaataaaaatgtttggccatttccaaccttgccttcagactatgggttcctggaggacaggtgcacttctcagccatctctggatgcactgatgtggccatctttgttagtgtactggtatggaccagtagggtccatacttgcacaaatcccaacaatcggtatttacatctctttgcttggccagggcccacaatgcctgtgcacaggacaggtcagaagtcctggagaattaacatacctcctgcattaggtcttcaccagtgactaactggagggatgtataaatatcccagctccttcactcctccagggggtgattctgagctacatgctcaacactagggttggcaaacttcttgaaaaagggtcatatagtaaatattttatgttttgccggtcatattgtctctcacagatgctcaactctgctgctgttgtataaaagctgccatgggctatacataaatgaaagggtgtgactgtattccaggaacattttattgaaataacaggtggcagaacaggtttgccatgggccaatagtttgcaaatccctgctctgtgtcattttccagagttcgccagagagattaaactgtgattccccacactggtaactgacatgataatgcatctttcttgccacttccctcccttgcctgtcccctttcccccacctcctcaagcttaataaactattggcactcaaatccttgcctcagagtctacttcagtgagcatccaaactaaaacagttgattaggactttttttgtttttttgcaagagatggagtctcgccctgtcacccaggctagagtgcagtggcgggatcttagttcactgcaacctccgcttcccaggttcaagcgattctcctgcctcagcctcctgagtagctgggattacaggtacgtgtcaccacgcctagctaattttttatttttagtagagacagggtttcactatatgttggccaagctagtctcaaactcctgacctcaggtgatccgcctgtatcagcctcccaaaatgctgggattacaggcgtgagccactgtgcccagcctgataaggatactcttgactgcaagcaacacagagttgaactacaggtgatttaaatattaattttgcaccaacctataatccagatttattgtatctcccacacaaaatccaggcgtaggtggtccagacaggttaattcaataatgtcatggctttgcggtttttctgatccttactagctcactactgagaaccaggtcatgtgcccaaggctaaaccagtcagcagtgagagaaacaagatgagcatgcctggcttgggccaactgagttccatgcctaagagcatgaggaaggaaggggctccatttctctgggcatattgccaactgatgcatgaatgaaaatgggatggtctcagcaaagaagaagagaaaagggttgctgggcaggtaaccaatacatacccagcagctggtgcttagaaaatgctgctgcagtctatgaatgcatgagccactggatgtaaacaatggatagcaactttctagaagaaagataaagttgaaggagtcatcctggacacacaagagtggtgcaaaataagcactgagtggccaggatgctcaggggaaatctcagaggctttagggagcatggttacctaactcagaaccatcagtgccaactaaggaagacacaaggtacattggttaaagtcaaggacaatcatgttcttcccctagttaataacagacatggcattttacagttcataaagctcttgtccattcattagtctcaccattcagtcaatgaaataaacccaggtaataatcaggtcaggtattattcttttaaaataattttatccccatttactgtgaaaaaaacttcttgagacagcttgcaataaaaggtacacccaaagggaaaccaaaagaaaaattatttgtttatcaaatacataagaaaactcatttaatatggttattttgattgcgtgtgctcttgggttttagctccctaatagccagagcaaaagaaaaagaaaacataaaggacacatgaatatcatcatttaacaaagggaagtatagctgttcacaggaaaggaaatgatttttcttagaatagaattaaaaaaaattccacttggatccttacataaggcaaatgtaactaaatgatggataatgtctcccatgatggttttgcagaagatatgagaatgtcctcattcatcatgacatttgaagtagtccattctcacactgctaataaagacatacctgaaactgggtaatttataaagaaaaagaggtggactcacaaatggactcacaattccacatgtctagggaggcctcacaatcacggcagaaggcaaaggagtagcaaagtcacatcttacatggcagcaggcaagagagggcttattatttttagtagagacacggtttcacaatatgttgggcaggctgacaactggccaagaatagcatggaaaagaccccccatcttgattcaattacctcccactgggtccctcccatgacacatgggaattatgggagctacaattcaagttgagatttgggtggggacacagacaaaccatatcaatatccctaaccatcagcttttcatacaaagccaaaggtttctccctgtggatggtatcatagcactgatacccataagcctcacttccattccacattgtcctggatatcctagctagtgcagttagacaggggggaaatgtccagaaaggaagaaatgaaacagtcatcattcctaggtgacttgatcgtatacataaaaatccaaggaaaattgttatggactgaatgtctttgtctttctccaccaaatccacacgttgaagccctagcccccagtgcaatggcatttggaggaggtaatttggtttagacgaggtcacgagggtattacccccatgatgggcctagtgtctttccccagaaaaacaatatcctttaccatatcccgaaaattataacaataccagttttaagtacttactatgcatgcaccaagtgtttacaggttttgatttactcattgaaacctcacagcagcctataaacccagctagtatgtggcagagttgagacgcaaacagaaaagcagtactccagatccccttggatccttacataagggaaatgtaaccaaatgatggataatgtcttccatgatggttttgtggaagatatgagaatgtcctcattcatcataatatttatattagtccattctcacactgctaataaagacatgcctgagactgggtaatttgtaaagaaaaaaaggtttaatggattcaagttccacatgttgtcatatgccacacttcttagggatgaatgaacatcaccatgatgccacacttcctagggatgaatcaacgtcagaattttttttttttaagttctgggatacaagtgcagaatgtgtaggtttcttacgtaggtatacatgtgccatggtggtttgctgcacctatcaacccatcatctgggttttaagcaccacaagcattagctatttgtcctaatgctctcccacccctcaccccccactctccaactgtccccagtgtgtgtcgtttccctccgtgtgtccatgtgttctcatttgaacatcagagcttaaagaagcattcctgctctcttctctccccgctgggctgggcttcaggtgcctcctatatgcttcctccatatcacctccacccttgcttgtcattgtctgggtttgaattcatttcctgagacttttgtaacaatgatctcaaactaaatggcttcaaacaacaggaatttcttctctcccaggtctggaggtcagaagactgaaatcggttgcaataaactgaaatcaaggtgtcagtagggctcgttccctatagaagtgctaggggacagtctgttccttgcctcttccagcttctggtggctgccagcattaacttgcttggagtggcatcaccccaatctctgcctccgtctggatatcaccttcttgtcttctgggtgtaatatctctccgcctttctcttataagacacttgcaatcaaatttagggcccacctagataatccagaataatctccccatctcaacatccttaatttaatcatacctgcaaagactccttttccttataatttaacatatacaggttccgcggactagaacctgatatctttgagtggccatgattcagcctactataggtttcatcactatctctttatcaactctgaagtccttaacagcagagaccacctgtggccattttcaaatggctgtacattttttacatcaaagcaatctcttagggccaggcacggtgcctcacatcggtaatctcagcaatttggaaggccaaggcgggcagatcacctgaggtcaggagttccagacccacctggccaacacagtgaaaccccgtctccactaaaaatacaaaaattagctgatgtggtggtgggcacctgtagtcccagctgctctggaggctgaggcatgagaatcacttgaacccaggaggcggaggttgcagccagccgagatcacaccactgcactccagcctgggtgacagagggagactccgtctcaaaaaaaatacaaaaaacaaacaaacaaaaacacacaataatctcttgggatctacaccctctcccttgactttaatgacctccatgattgctttgatgtattgaatatggtggaaatcatactgtgcccttttccagtccatgttttaaaagactatcaagcgctacttcctatatcttgaaatactcacttttggaactcagacaccactatgctacgagaagcccaaaccacatagaaaggccacgtgaaagtgctccaggcgacagcaccaactgagctcctaaccagtagccaatatcatgccagccatgtgtctcagccatcttggatggccagcctagtcaagccttcagatgactccagccccagtcattatctgactacaactgcataggacttgaaatgagaaccacgtaggtgagcccaatcaacacagagtcatgagcaataataccaaatatttgtttccagccactgtgggatcaggctcttttttatgcagcaagagattatctgaacatcatatttgttgctgcataccaggtgcctggaactatgcctggaggtcttgatattcaatgaaagtggaataaatcaaataaataaaaatggaataaataaacgaaactctagaagctatggattctagggagttgagctggagatcaggaggaatggatattaggtctcaaagaaatgacaaggtaataaggtagaagaagaaggctgtggataaacaaattttctggggccttaatggtggtgagaagtgggcaagttcaatgttgagcaggaccaaattcaacagaccctcagcaaatgtttgctcacttagcagtacacagattctgcatacatcttccttccttttaaccattcctttaattgtataagcaatatattgagtatctactgagagccaggctttgagttgggtgaagactattcagcagttaagtccctttaatgcttatacactgttgatgggaatgtatattagtccagtcactgtggaaagcagtttggaaatttctcaaataacttaaaatagaactaaggttgaatccagcaatcccatcatgggtataaatcccaaaagaataatcattctaccttaaagatgcatgcacacatatgttcattgcagcactatttacaatagcaaagacagggaatcaacctagatgcccatcaattgcagactagataaagaaaatatggtacatatacaccatggaatatactatgcagccataaaaaagaatgaaatcatgacctttgcagcaacatggatggagctggaggccattatcttaagcaaattaacacaggaacagaaaaccaaatattgcatgctctcacttaggaggtaaacactgacttcacatgaacacaaagaagggaacaatagacactgggtcctacttgaaggtagaggatgggaggagggtgaggattgaaaaactacttaccaggtactacattcattacctgggtgatgaaataatctggacaccaagccccataacatgcaatttacccatgaaacaaatctgcgcacgtaccccccaaacctaaaataaaagttggaaagaaaataaaaatgaaaaacaagtccctttcttatggaacttaacaaccatagagtatttggggaaacctcaaaaccacaggcaggtggttcaagcccccatctctgaccttcattaccctgctgtatagccatgattacaaaaaaaaaaaaaaagccagaccattcaatgctattgcttctctcttccaaatgggatgaagtgcaggcagtaaaccagggaagatgaacttggccaagtccttctattcattttgtggcagtgatgacaatttcccattgtggggagctggaggggcagtctccttctgttcaaacgactcagcacacttttgagggggcataagaaccagaaagtgcaggtgctagtaaagcaggcctgtatttacagggagaatcagtccacagacttcagcttctcaaaaccattgttaatgtgcttttacaaaatgcaaaatgctgctagacagttcactgggtggccttgggcctacccagttcttccctctttccccaactcatggttcttaagaataactgaagaatgtgctagaaatgcaacatcttgagatagagagggactggccagaacgacccaacctctgttccagtccacccctagaaacaaaatgtcttaaacactttagcccagcaaatcacacatcctggggtataaaacacagaaccagctgctttctggggtatctgagcttctgtgtaagtgaggcatgcacagatatgactctacttaccctcagcaggtttccggggacttggaggaatagctcacaatgaatcctaggcttctaccatctcttgctgcctatctgtaagtaataaacctacctcatgtaacttgttgtgtgggagtgttctgtctcactggacaagttggtagccagtgaacagtgaacctgcctcacaaattcctctgctgtaaagtgcaccagaagctctcagtcatggaagttctgtgctcaaatcttccttcaaggtgaactgctctggaagcagagctaactgacaacctctagctgctgtaccttttgacccaccgaggtgttcatgctaggctgcacttccctggggatcttcccagccagtgactgggcacagcggaagtaatggaattaggtgattctaacccaactgggagttgtccaacagagagagttgccttaggaactattacggctggctgatacattctcagagttgtgctgaagcctttctctttctaactatctctcttccttcccactctgctttcagaggtgtcagacctgcattacggtctgaaatctctccctgctccctccccatttcccttcacaggcattttcttcaatgaatttcctgcacaattaatacttggttttctttcatgttgtaaaccactgtaggatgactacagttaacaatatgtagttttggccaggcgcagtggctcgttcctgtgatcccagcactttgggactctgaagcgagcagaccacttgaggtcaggagttcaaaaccagcctggcaaacatggtgaaaccccatctctactaaaaaaatattagtcgggcgtggtggagcgtgcctgtaatcccagctacttggcaggctgaggcaggagaatcgcttgaacctgggaggcagaggttgcattgagcagagatcatgctactacaaatcagtctgggtgacagagcaagattctgtctaaataaaataaaatgataatagtaataataatgcagtttcaaatagctagaaggaagatactgaaagttaccatcacaaagaaatgagaaacgtttgagatgatggatatgctaattaccctgatcaaatcactatacattatatatatcaaaacatcactacgtactccatcaataggtaccattatttttcaattaaaaaataatttttttaaaaaaagaaatatagaatgttatacttgtaaaaagaagaaaatggaaactgaggaatcaaattatgtaagagtgatcttccttctcatcagctatcattttagaaatttgtaggaaaagaggagataaaggaagagagcaagaggaagcaaataagcagagggaggaaaagaggagaaagtaaagaaagaattagaaagtaaggagacacaacagatcagatcagctaccataattcaaatgctcgccaaaatcacttcctatatttgcaatacagaagctgcaggagacatgttatttaaaattagtaagagggccgggcacagtggctcatgcctgtaatcccagcactttgggaggccgaggtgggtggatcacaagatcaagagatcgagaccatcctggctaacatggtgaaaccccgtctctactaaaaatacaaaaattagctggacatggtggcatgcgcctgtaatcccagctacctgggaggctgaggcaggaaatcacttgaacccgggaggcggaggttacggtgagccgagatcgcgccactacactcgagcctggcaacagagtgagactccgcctcaaaaaaaaaaaattagtaagagaatgagaacttcatacagaagttgagaagtggatttgaaatcagtggagactgggaccttgtacaattaattctgttttgccttctgctactcagaggacctgaactgactcacctaccgtctagagacagctactattttgtatttcttttttagtttcatgcatttaatttgcatgattatcattttgctttatttccccattttacattataatatgtgccacctcatgttactgtgcttcatgtctattattgatgccccataacattccattgtatggaagtatcataaatatcaactatttccctttagttggacattcagggtctttccagatttttttcctaattaaatgatgctgcaataaatgccttgtttcgctccttcagaacaggtcattgcagtaagggcctctccattggagtggtggattttagttgtctgggacttagggttttggttctgattctgctacatcctaacagcatgaccctgagcaagttacttggtttctcaggactcctgtttcctcacccatcaaatggaggtaacaccagacaaggatcctttgtgactatcagatttaatccatggcatcattttgaaaatattttcttttttcttttttttttttttttttttttttgacacagagtctcactccatcacccaggctggagtgcagtggcatgatctcagttcactgcaaccttcgcttcatgggttcaagcaattctcatgcctcagcctcccaaaagatttccatgtaaggtgcttgcaaagggaaaaataacaacttgtgtggtcaaaaagtttagaaacccctggtctaaatggcgttagcaggacttatcagagcctttattataacagcacacagtcccaaaggtagatccttatggtattatcttagtctattcagactgctataagagaatgccataggttgtgtggcttacaaacagcagacatttatttctcacggttctctccagaagatctgggaagtcccagatcaaggcacaggcagattcagtgtctggggaaggccttcttcctagttcatagacagccctcttttcactgtgtcttcccatcatggaagggcaaaggggctctctgggaccccttttaaaagggcattggccaggcgcagtggctcacgcctgtaaacctagtactttgggaggccaagatgggcagatcacttggatcaggagtttgagacagcctggccaacgtggtggaacctcatcgccctaaaaatacaaaaaaaaaaaaaaaaaattatccaggtgtggtagataattatccagtagtctcaactactcagaggatgaggcaggagaatcacttaaacccagaggcagaggttgcagtgagcctagatggtactactgcactctagcctgggaacagggtgagactcttgtctcaaataaataaataaataggcatgaatcccacttgtggagtccccaccatcatgtcctaatcacctcccaaaggccccaccccctaataccatccatcacactggggattaggtttcaacacatggtgggaacacatttagtggatagcaagcatgaagcattaatcaagcttatttgcccatcatgcccatgaaattctgaagtctgacaagcagcctgtgagaagaaagacatacaacaaggaggtaggactatggtgctttggggtggaggccactgatgaaaaactcacccctcgaaagcatctcctactttgatacctacggatgcaacatccaggtagaaccagcctcgatgtcttctggagcccaggacctgatctccaagctggcccaagacaaccctcagagtgccactgttcaagctcctcttgctccataatcactttaaagaggctgcccccacccctggggctcagagggcttcctgtgacctgacactatgatcgtgagcgagtgccgcgctctgttcccaactatgcttcctcatctgtcatccatggcttttcttttaaggagttatttacgaagagctgaagcaatttgcttttaaaaatgaaaaacaacagaactagtattttttgtaagtcagcttgataggcagtaaacaatcctgccaaagcaaagcagaaaatgctgaaaaggttcatgtctcttcaacgactctgaccaagacttcagaggatgctccaaggggagaaacatgctcagggctacagaagcgacaatcatggataccctaagctggtctttcccaggagcaattttaccatgcaattttccctggatcctttctctatcgccccataacacctctcccatttggaaacaaaaatataatctttgaaagaaaaatagaaatcactgtctaaataaaaataatacattcctagcattcattcaccctcttcatcctcctccctgcccctgcgggggggaaaaatctcatttatcatgttgaatttctcatctcttgtgaatgccacgcaattgggtaaataagttctgtgttcaatcttttgtttttttgtttgtttattgctttattcattcacaatggaaagaaagactaaacttcaggtagagataaaagaatataagatgtatttttaactgtccaagatcatgggatctccgaattctattcatgatagaatgtttgagcatctgtggaccccagtttgtgaactcttgccctgaaacaaagcctgccagttatctgtgttcaatcttttaacaggggttattcaatttactcaagccaacatgagaggtttccatgacaacctctcagcacattcagtcttcatataaatgagttattgcttttatgttctcatactctaagacaatggggaaattaacataatgtggtcatacaaaaaaaaaaaaaaaaacaatcaaaacaatcaaaatcctcatatcctccccagaaactcacagatagcattcggtgaaaaagaaccaaagagaaatgaagccttcacatctgacaacactgttaacattagagatttcatttcagatgcatttaaatgaagccagaccataatggggttcaaaaaaaagtgtatagacataactaaactgcagaggaaagagacgtaaagtcagggacccaaattcactttcaggccatatatcctccaaagataaccaccattctctgcctctctttctgcaccccatccacactagcattcctgccccaggaccttcgcacatgctcttccctatgcttggaatgttcttcccctgctgttcttccagtgctgctttgcttagctaactcctactcatcctcaggtctcagctcagcaaagtcacttcctcagggcagtcaagctttgccactcatcaagactaggtaaaattttcttgttaaatctatttatggattttcctggttctttgtatttttcatcatcttagataggttagatttccccagaaacaaatcctaagagaaggtgagatggtttggctgcgtccctacccagatctcaccttgaattgtaacaatctccatgtgtcaagggcgggggcaggtggagataattgaatcatgggggtggtttcccccatactgttctcctgatagtgagtaagtctcatgagatctgatggttttataaatgggagttcccctgcacaagcctcttgcctgctgccgtgtaagatgtggctttgctccttcttgtcttccaccatgattgtgaggcctttccagccatgcagaactgtgagtccattaaacctctttcctttataaatgacccagtctcaggcatgtctttattagcagcatgagaacagactaatacagaaggacttgaagataagtgggttgatttggaaagtgagcccaggaaacactgggatgacaatagggaaatgagacagagaagggaaaggagctaatccaggtcatgtttataagcaggctgctactatgggcaactggggttcaatcccactggggacatctgggagacagcatagcgcctgcctcaccctaaggtatggaaggcagggcaactgccctcagcagctggctgggggagatgtgcctgtgttggtttctctgcacttccagcctgccccacaagagcctaggttatggcagtgagacaaagccccaggcagtattgcagatgcttgcagtaggaatggtgagtacccagaggacataggcaaggcaacaactacatctgccaccttccccaatgcaaacagcataattattgctggagactggagatcagtggaatagaagacagaagatttaattcaaagccattagacaaaaaataatagtcccattgaagacaaaggcatgggaatacggggaaggtataaatccacatgaatagacaattttcaaaagaagataaacaaatggccaacaaacacgtgaaaaaatgctcaacatcactaatgatcagggaaacgcaaatcaaaaccacaatgcgataccaccttactcctgcaagaatgaccagaatcaaaaaatcaaaacataatagatgttggcatggaggtggtgaaaagggaacacttctacactgctggcgggaatgtaaactagtacaaccaccttggaagacagtgtggagattccttaaagaaaagtagcaccaccatttgatctggcaatcccactactgggtatctaccctgaggaaaagaaatcattatatgagaaagatacttgcacatgcatgtttatagcagcacaattcacaactgcaaaaatatgaaaccagctcaaatgcctatcaatcaacgagtggataaagaaactgtggtatatatatgccatataccagcagtatatttatactactcagccataataaggaatgaattaatggcattcacagcaacctggatggaactggagattattattctaggtgaagtaactcaggaatggaaaaccaaacgtcgtatgttctcactcacaagtgggagctaagctatgaggatgcaaaggcataagaatgatacaatggactgtggggactcgggggaaagggtgggagggggtgagggataaaagactacaaattgggttcagtgtgtactgctcagataatggctgcaccaaaatctcacaaatcactattaaagaacttactcacataaccaaataccacctgttccccaaaaccctatggaaataaaaaattttaaaaataaaaaataaatttacatgatataaaagaccttgactctaggcctgggtgactgattatatactggggtacaggttttagtcaaagagctggagactatatggaaaaggggtgtctaaggccctctctgacattctaacaacccccatcatctcttttgctggccaggggcccacctggtaggacagtccaatccagggtaattctggctcacaggtcacacaataccaatctttggtcccaaggttaggagtggctgctcccacaatggactttataataacctctccaacctctgtttgttgagcttagattcttaagcctctaagcttctgatgactcttattagagaaagtaatataattacccatcaataaagaaatggctcattcagcaaggatatatctgttcaatcaaatatatctgttcaatcaaatcactaaaaacaatggccgtttaagagtacatatacaaaaggtacgtgtgcaacagtataataagagcaaacctaaattatgcttgttgttcactgattgtctccccacagtagcatggaagttcagcaagagcagggatctttgtttttgttcaatgctaggtcctcagcacctaggactgtgccaggcacaaaaacatccagcacccaccaaggtaaaatttacaatgtctgacatcccataaaagttactttaaaaatagaggctgggccaggtgccgtggcccacgcctgtaatcccagcactttaggaggccaaggtgggtggatcatgaggtcaggagatcgagaccatcctgccaacatggtgaaacctgtctctactgaaaatacaaaaattagctgggcatggcgacacgtgcctgtaatcccagctactcgggaggctgaggctggagaatctcttgaacttgagaggttgcagtgagccgagatcgcgccactgaaccccagcctgggcaacaagagctagactccgtctcaaaaaataaaaaaatagaagccagtggccaggagctgtgaccgacacctgttatcctagcacttcgggaggccgaggcaggtggatacttgaggtcaggagttcaagaccaacctggccaacatggcgaaaccccatctctactaaaaacacaaaaattagccagtcatgatggcacacacctgtagtcccagctactcggaggctgaggcacaagaattgtttgaacccaggaggcagaggttgcagtgagccaagactgcaccgatgtactccagcctgggcaacagagtgagactctgtctcaaaataataataatagaggccaggcatagtggctcatgcctgtaatctcagcaatttgagaggctgaagcaggaggatctcttgaggtcaagagtttgagactagcctgggaaacaaagcaaaaccccatccctccaaaaaaactttttaaaaactagccatgcatggtggtgcatacctgtagtcccagctactcaggaggctgaggcaggaggatcacatgagcccagtagtttgaggttgcagtgagctatgactgtgccactgtactccagcctgggcaacagagcaagatcctgtctcaaaaaaaattaccttaaaataataagtaaataaatatcaattttacaataaaataaaagtgactcagcctaccctgggtggggttaagggctggcctctatcacacctatcagctcccagaggtcctggatcccccagaagctgctaggaggggctgagggccattactcagaagtgcagagtggagcaagctttgaccaataagagacaggaaacagcaggagctggcagatgactgactccagagttatcccatgcttgtgtttctgggaaactgcaactccactaggcaatatacacttctttggttttgctcttcctctttctctctttcccttatccctgctttcttgagattgcgtgacccaatgaaacatttgcatatttgtatcaggcactgttggtaggctaagataacctccatccccaaaacctatgacacatggggtatctcctgaaggatgccattcaagttaatccccaaacattatggcttaaagccacaactgtttttattatagatcatgattttgagggtcaggaatttaagcaggacccagctgggcagttcttctgctcacacagtatcatctgaggtcactcagtagtattcagagggcttcggggctgctctgaagggtctagtgcagttttagtgatgtgccaggcaccttggtgggtgtattagtccattttcatgctcttaacaaagacatacctgagactgggtcatttttacaggaaagaggtttaatggactcagagttccacatggctggggagcctcgcaatcatggtggaaggcaaggaggagcaagtcacgtcttacatggatggcagcgggcaaaaagagagcttgtgcagggaaactccctgttataaaaccatcagatctcatgagacttactatcatgagaatagcatgagaaagacccacccccatgattcaattacctcccaccaggtccctctcacaacatgtgagaattcaagatgagatttggatggggacacagccaaaccatatcagtgggacaggatggaagctgggctcagagcaacttctctccctttccatgtcatctcagagtctctccaggtttccctccagcaaaagccctcagatttcttacacagtggatcaggggtttaaaaccaagagttccaagaggtgtaaggtggaaactgcatgatcccttaaatgccaggaccagaaccatcatggtgtcacttctatggcaatctattcgtcaaagcagtcacaggccagcccaggctcaggaaaagggaaatagaccccatttctgaatgcatggggtatcaaacagtttgcactcatctttgacctgccacagatacacaagaactgggaggaggggtgggtggaagactgaagcattagagtaagaggggctccttcatcctccggtcatcattttccatgtgcacgtctgacttttttcaaataaaaactggggaaggacaaaaagtggggaggaaccatgtcaataagctgaatcctcatcttctatggcacagagtcaatagaaaatgtcttaaattgataaatcaagaaaaagcctcataagcatcttatttggagttacagagataaataactgaagacctaaaaatggaaacaacatttcaagcacttgcctccgggaaataagacttaaggaggggagagaggagagaaggggccaggaaccgctgctttcattggcagctcctctgtactttaactttgtacgatgtgctcatattactatgattttttttttaaattcaaaagggaaaaaaataagaacaaaatgatgatggttatttttaaaactatgtaattaaacctggaaaaatctcattttgctaaacggaaaaaaagtagcaggatacgaaactatattaatagtatggtcataagtatgtttaataaagaaagagaaaaacatatatgggaggagaaaaatctgaagaaatttacctaccaaatgatagtgggtgggtttctctacttttctaggtttcccacattttcaacaacgtgattctcatactttcctaatgaaaagaaatacattccttacataaaataaattaactgggccgggcgtggtggctcatgcctgtaatcccagcactttgagaggccaaggcgggcagatcacctgaggtcaggagttcaaaactagcctgggcaacatggtgaaaccccgtctctaccaaaaatacaaaaattagccaggtgtggtggtgtgtgggtgtgtgcctgtagttccagctatttgggaggctgaggcaggagaatcgtttgaaccggggaggtgggggctgcagtgagccgagattgcgccactgtactccagcctaggtgacagagtgacattccatctcaaaaaaaaaaatgaaaatggctgggcgccgtggctcacgcctgtaattccagcactttgggaggtcgaggcaggcagatcacgaggtcaggagttcaagaccagcctggccaagatggtgaaaccccgtctctactaaaaatacaaaaattagctgggcatggtggcacttgcctataatcccagctactcgggaggctaaggcagagaattgcttgaacctgggaggcagaggttgcagtgagctgagatcgcgccactgcactccagcctgagtgacagagcaagactccgtctcaaaaaaaaaattaaaaaattaaaaaataaaaataaaataataaaataaatgagccgagcatcaattaaagaaaatgccagaaggttctctgaagaactttccacaatagaagtgtattttaagtccctgagccttcatctcatacctatggacaggggactctttgcactggttctggaacgctccagtccaccatgcccacggatttagttaggaaaccttcccagaaagaacttagtccatgtcatttcaaaatgaattaattcaactcaacaggaacttttgtaagcctccaatgtatgcggttctgaacttttgtaagcctccaatgtttccagttctgaatctggaatgctcattcagccacaaaataaacatttattgagtacctactatgtgccagacaaatgctacttgcaggggtgacaatgatagagacgggcaaaatattcaattctttggagccatagactaatgggagaggcagacaagtgactaggcaagtgtaatacatcctaacagacactttggggaacagacaaggggctgtggaaggaggcaacctggagggcttcctggaaaaggccaaacatgggccaagcgccgtggctcatacctgtaatcccagcactttgggaggttgaggcaggaagatagatcacttgatcctgagagttcgaggccagcctgggtaatatggcgaaacctcatctctacaaaaagtacaaaagttagctgggcatggtggcatgcaactgtagtcccagctactcgggaggctgaggtgggaggatcacttgagcctgggaggttgaggctgcagtgagtcacgattgcaccactgcactccagcctgggtgacagggtgagaccttgtctcaaaaaaaaaaaaaaaaaggccaaatatgagctcagagctcagtctcaagggatgaaccagggcagatcaggttaaaggggaaaagctgttgccagtacagagaatagaatatacaaagacccagaaacaacagagaagatggatacattcaaggaactgagagtgatctcaaaaaaaagatttgtcatgatcagaagagacagtcccaaaccagcactcacttgggggctctgggactggactccctaaattggaatctcagccccatcatgtgagctcaaagtgcttcacctcactgtgcctcagtttccatgtctgtaaaacagggtagaagtagaacttagaagagttataagaattaaactagagaagtgagcattgtttatatgtgcttgttgctatggatccaaaactgccagtaataacaataataataataataatagcttatgctttcgttgagcccttgctttgcacctggccagtgacaggcacattatcagtaacacaaatgcaagtatctcatctaacccttgcatcaacgctcagagatgggttttatcaacatccccattttacagatgaggaaaactgaggcagagcagttgcacaacgtcgcagctgttcctggtgcttcacccagatcctcattgccagtaaaccattcatcattcagcctttgctgatctgtgcctaatggcttataccaatactttctccggagaattccttagctagcaaaagccatttcacccagggagttatgctctcacatgctgaactggccaatgactaagcgatatgaggcgagaggagtcacacaaaagtccagtcctcctgcttcgaggcagaatacactccagagacccacgtgagatcaaggctagccttagcctgagagcccattcttgcttggctctgtcccctcccccatcatcctccttccctcactttccttctcctgagaacccccaccttgaataaaccgcacctacccaaatctcattctcgggcttccaaggaacccaacccgtcacacaacttgcagggattcggaccaggttttctccttccaaagggccaccaagctgcaagctgcaccaggttcatctcaaaatcagagtcatgggatcaaagaacagttgctgatgccaacccctgccggcatgagcccaccgctggggaaacaaggcgaaccagacatctcagactagaggagtgaatccaaggagagaagatgacaggaggtgtatttgttctcacgctgctaataaagacctacccgagactgagtaatttacaaaggaaagagggtgaatggactcacagttccacatggctgaggaggtctcacaatcatggtggaaggccaaagaacagcgaagtcacatgctacacagcggcaggcaagagagcttgcgcagcggaactcccatttataaaaccatcagatctcgtgagacttactcactaccatgagaaccgtatgcggaaactgcccccatgttttaattatctccacctggccctgcccttgacacgtggggattattacaattcaaggtgagtttggatggggatacagccagaccatatcaggagagggcacagcattaggacgcagccggtggtactgtaattcgggtcgggggaggttgctgaaatacactcataagggtagtttaaaaagagcatcatcaaggagacaggctttccagccttggccttcgggagaaagaaagagagagtgaaaaaaacatgggctttaggcctgacgcgtggctcacgcctgtaatcccagcactttgggaggccgaggcgggcggatcacgaggtcaggagttggagaccaacctggccagcatggtgaaacctcgtctatacaaaaaatataaaaaattagctgggcatggtggcacgtgcctgtaatcccaagctgctcgggaggctgaggcaggagaattgcttgaacctggcaggcggaggttgcagtgagccaagatcattgcgctgttgcacaccaacctgggcaacatagcaagactcggtctcaaacaaacaaaaaaaaggggaggggcagggctttagacagatccaagctcaaccctgcaagttgccgggactccgtttctttatctgtaacatggagatcacgatgttcacctcgcagagtagattaagcagctggcatgtgtgaagtgcccagcactgtgtctagcatatgctaggtacttggcatgtgtttctttctttccctcccttgttcaaggccacatagtccatgactggcagagctagaagccttctcatttacccacaatcaaagaacttctacaaaatagaaacagccccctgccccctcctgcccccgcccacctgctaccttaataggttatttcccagttattcaatgcaagagacttagcccagctaaagttattcaaaatcgaccttgagatcaggaacaaattggctacagcagtcagcgattggcaaatgcaatctaaatgccccaggcggcattagagccttccacgttgacaggaagagtcaatgtgcatcttggaaaaatctgagaaaaaaaaattaaaggtcaccgcatttgtaggcagaatgggttttcttgagaccattacaaacagactgcctaaattgcaaagattccaggcttgacagctcccggaggactccagatggaaagaacaccacccccatctcttatacatccaggctgctgtctgtggacgtccgaaggttctcccaccacccatgctattattgaaattccacaatcaacctgcaatgccccagtgaaccattttgctgggatgggaggaccaacttagggccagccctgtgttccaaggggctgaccaggcaggacagccaaggaggcacaagtctgtaagatgggtccaaacatttctgtaggaagggggtcttgagccaaagcaggaaaaatcaaaccccaacacaaagtgtagagagagtcggatcataaatcacacacagacagggtccgagaaacatgggctggggaccagcagatgacaggctaggataattgatcattagaacatctgtgctgtttttgttgtaagaatagtatcaatattaataacaacagctaatatatattgagtggcttctggagccaggcactgtggtaaacttttgcacgtatcctctcacttaatcctcacagtgctctacaaagtgggtactggattcatgcccatttcacagagaacatatctgaggctcagagaggcatctacaaggtcaaccaggtaatcaggaaagccagatttcaagggcttgtccacatcactctatgacatgtggggaactcaagtgtgtgttggcttaactcaaataaatagtacaagttaggctgggcacggtggctcatgcctgtaatcccagcactttgggaggccaaggcaggtggatcacctgaggccaggagtctgagaccagtctggccaaagtggcaaaaccctgtctctactaaaaatacaaaaaattagccaggtatggtggtgggcatctgtaatgcgagctactcaggaggctgagacaggagaattgcttgaaccccgggagacagaaattgcagtaagccaagatcgtgccactgcactccatccagcctgggcaacaagagcgaaactccgtctcaaaaaaaaaaaaaaaaaaaccaaccaacaaacaaacaaaaaaacaaataaatagtaaaagttacttctcaacacgagccagtcattttttaaagtatcttacatttttcttttcctttacttattactttttgaattgacaaacaaaaattgtctataattattgtgtacaacctgatgttttgaaatatgtatacattgcggactggggaaatcaagctaattaacaagtggtggggatgcttcaaatttactctcttggcaatttgcaagaatacaaacacttttattaattatagtcactattttccaaacaaggaaacgaatgcccagtaaaagtacaaagtaacagaactcctcactgaagctggggtcatgggtgaaaaagataaatataggctgggcgccgaggcttatgcctgtaatcccagcactttgggaggcagaggcaggtggatcatctgaggtcaggagttcaagaccagcctggccaacatggtgaaacctcatctctagtaaaaaaaaatacaaaaaaaaaaaaaaaaagctgggtatggtggcaggtgcctgtaatcccagctactcgggaggctgaggcaggagaattgcttgaacccaggaggcagaggttgcagtgagccgtgaacgtgccattgcactccagcctgggtgacaagtgtgaaactccatctcaaaaaaaaagataaaatacaaatacatccatatataattaaaatatgatagtggtgtgttttcctgtttaacaaatatttacttccctctcattcccttcaccatgggaagaacagaatcctctgccccgttagtgatgggtttgttttggccaatggaacatgagcagagctgacggtgcaccagttcccagcttagaccttaaaaggcattgagtatttctgctcactcctctctggaagctgccaaccttcaccaggtaccactgcttctccaatctggacctcagaaataaatgtaagaatcagacttgaactcaacccacagcctaaagcagaatctctccagctaaaccacagacctatgagcaaaaaaaagtgtttatttttataaccatgagggtggtgttacttgttacacagctacaggtaactgatacatttacacgtgaatatgtgcacatactatacatgtgcatattatataggatacatatgtgtggccgtgttacatggaaatagatacatataaatccttaaaatgtatctccatatgtgggatatttatacatatctatttgggagatagtaaatgaggtagaatttggagactgctaaatttgcattcttgcattgacacaagctgtgcattttgggggaaattacttgacatctctgagcacattttctcctttgtaacatggagataaagatgaagcttatctcataggattactgtgagagttgagtaaaataatacacgtaatgggcttagcagggagcctaacacacactcgctcacacccattcattcaataaatgttattgagtaaccacatttgccaggccctcttattggtgtttagaacacagttactagctgtggggaaaaaagcaaaaataaaaaggataaggagagccagcagccccggaggaggagggaggcaggcataggatgtgcctgtgcctggcacgtagtaagtgctcaattattggtagccatttttattctcaaagtgattaacgtgagaacaagggggtcagctggagatttaaaaaacaataatcagtctctctgctccgcagcagacccctgagacccttggcaaaccccagcaatagatcaaggaccttcagtaggtgaatacagtcgcaggaactgctatagctgacacatagtccctgcaactccagccagacgccagcaccagctgccactgggagatgtgagcttggcttctccatgaaagagaaagattcctggggcctcagccatgcctcaaacccactgataacatcaaacacacattgctggggggagccggccaggtgctcagaagctgcagggtgaccctgcatgtaggtgtcgggaagtcagcagcgactcgcgggtggagaaacacccacgcctttgcaaacactcttaatgtaatgcactgcccttgaggccacctcccgtttttttggccctaattggcatgtttttctgtctcctcagaaacagccacgggagacaacattccatagcagttaaaagtgtggtctctgggtttgcaaccagactattccccaccagctgcaaccttgggcgagacacttaaccccaggagcttcccctcccgtggttgtgatgattaaatgagataaccagataaccccttagatggcaaacactcagcacagtgcctgatgctcatcattgtggcttttattacggactcattttataaacgaggacatcaaggcccagacagcttaagccatttgctcaaggtcagaaggtcactctaaccttgccatcaaatcttgggattttctttttcctccatcacaccatccccaactgatctactcctcaagtgaatttcagaaatcctccaaagatgaattttgatctacctagagctgtgctgacttaactggagcatagcacatattttcaaaacaggaggaaacttgaccacagctttgagccatgtggatgataaagtcatcgtaggtgaacttgagactgggattcggcccttgtgtcaattgtgattagcacagagtgaagcagcgtcattctctcgggggtaatacctgagattcgttgcctcataccaaaaacattaaggacacagacacacacaaagagtgagtttaaaagcagaggtttaataggcaaaagaatgagaaaggagaacactgtctctcttccgagaggggggcacccagtgggacttctggcccaagtcagagtgcaccagattttacagggttggggaggcggtgcctgatttactagggcccaaagattggttgcaccaggtgtgacatttacatagcgcatggggaagttggccgccccaccctagtgttactatgcaaatggggtctttgcctggctggctccttgttgcctgctccttactgtacacatggctggcaaagagaagggaagatggaactgccgtgttggacgtgcctagccccagctagccttttcttatgggcggagctgccggcattcacccgtgcaagcttccagcttgcttgcctatgtctgcagcttgattttacaggatgctctccgttagaaaagaaaaatgatttggggactgcttttcattaaaaggaaaaccttactgaggacttccttaccctcactatctgcctaaataatttcttcttaactcttacatcagtaatatgaactcaacagactgaaagtaacaatcagatcacaaacacagatgtctacagagtctggaggttactagggtgactatccatcctggcttgagcactgcaagtcccacactctgggaatccgctcaggcctgggcaaaccaagacagctggtcaccctcgccgtaacataagtgagtaaaggtataaaaagctgtgcctgtctcagcgttttccacttctgagaagcaatcatgtatggtggttaaaagcaaggactctagagccagactcacttggtctataccccacctccgttgcctaccagctgcaggacctcacacaggattacccaacctcaccatgcttccgtttcctcacatataaaatagagatattagagccccctaccctaggtcagcctcaacaccactgacattttggacctgatcgttctttactggggagtctggggacagccctgtgccttgtaggatgtttagcagcatccatggcctctacatactggacgacagtagcacagtataccctagttgtgaccatcaaaaatgtctccagacattgccaaatgtcccttatggggatagaagtgtccccagttgagaaccagtgtcgtaggcagtgttgtgaggataagggaggtggtacatgcaaaatgctgagaaaaagccatgacttggagagtctgtttctacaggaacagccaataaagccttagagatggagcaggaaggtggcaagccaagagctgagcaagcaggaccttggagggaccaagggcagggcagccaagccactgtgaagtggaacaagttctgcaaacggaggccagcccggccaccctccccctcacctctcacacaagattggacttctatttcaccccaggtgcggaaagtggagtgaattactcctcagtttctggcatggcaccacggtgcagtgcaaaaccccctcagctgaggtattcctcttctcttgaatgtgtgcgcattcttgtgaagtgcatttgctcatcaaatattgagtgttcagaatgtggcacgaagacagcggtgaacaaaatagacagaaatccctgccctcttgtagctttaagcatactgtcttgtgtacaaatacatttttaaccaataaaaattgtgtcatactatggtctagatatggtttgttttggcccctgccaagtctcatgttgaaatgtgatccccagtgttggaggtggggcctggtgggaggtgttttggtcatgggggcagatgcctcaggaatggctgggtgccattctctcaagagtgagtgatttcccactcttagttcctgcaagaactgattgtgtgtgcgtgtgtgtgtgtgtttcaagatggaatctcgctctgttgcccagactggagtgcagtggcatgatttcagctcactgcaacctctgcctcccggattccagagattctcctgcctcagcctcccgagtagctgggattacaggcacccgccactacatccagctaatttttgtgtttttatttttttctatttatttatttatttatttatttatttatttatttatttatttattttgggacacagtctcgctctgtcagccaggctggagtgcaatggcaagatctcggctcattgcaacctccacctcctgggttcaagtaattctcccacctcagcctcccaagtagctggagttacaggcaagagccaccatgcctggctaatgtttgtatttttagtacagagagggtttcgacatgttggccaggctggtctcgaactcctgacctcaagtgatccacccacttcggcctcccaaagtgctgggattacaggcataagccactgcatccggccgagaactgatagttaaaaataacctggaaccctcctctgtctcctattcttccctgtctccttcttccttctctcatcctccttcctcatacccctcttctctccctctctctctctctctatcttaccatgtgatctacacacaccagttcctcttcacttctgccatgagtggaagcttcctgaagccctcatcagaagcagatgttggtgccatgattcttgcagaatgatgagccaaataaactttttttctttgtaaattatccagcctcaggtgttcctttatagcagcacaaacaaagacacttgctataaattgattctgttgctcactttttttccccttgtgctttgtttttaagatccatccaggccgggcacagtggctcacgcatgtaatcccagcactttgggaggctgaggtgggtggatcacctgtggtcaggagttcgagaccagcctggccagtatggtgaaaccctgtctctactaaaaatacaacattagccaggtatggtggcgggcgcctgtaatcccagctactcgggaggctgaggcagaattgctggaacccaggaggcggaggttgcagtgagccgagattgcaccattgcaccccagcctgggcaacagagtgagactccatctcaaaataaataaataaataaataaataaaataaaagatccgtccatactggcatgtgaagatcagacctgtttttctaactaccgcagtcatatcccacagtgagtatctgtcatgctttgcttatctatccccttctgatgcgcacagcagtggcttccaataccccgctaccacaaacccacctccttgaacatccttgggtgaaactttctctggggtataaatccaggaggggaattgctgctgctcagtctttaatatgcacaggactcacccagggatcttgttaaaaggcagattttgactcaagaagtctggaaggagactcgagaatttccatttctaacaagctcccaggtgatgctgatgctgctggtctgggaccacagagaatatgcagccttcatttgctttagtgtcagatctctctagaatgaccgcgccagtccacagtccaagggcttgcttttagagggggccaaaccccactggcccccctaacacggtgtagacttgcagggctctgctgagagccaccattaaccacaagcatcatgtccgtattgctaccgttcgtcaatacccttgaccctcttgccttcaggaaccctctatttccaagcacatctccaaatcagagccccaccccctccacaatgcaaagtgggaccatctagaagaacatccagcccaacctcctggctttataaagggagaaaccaagactgagagacttgcaagaaatcacaagaaattcccgtttctttgcatcttactcctccagagccctctttgagtgatcagtaattcgtccacaatttataggacttagttcactttacccatctttttccatctccctgccccaccccactccaccctccccatcccatatcccccagcccaccctgctttttaatccttgctagaatcatccattttgcgaccaagtattgacttcaaatgatatatgagacaattgacatttcaaatattccaggcaggatacagaattctgatcacggcccagtctgaaacatctcctccacatctctttccttattccttctgggcaataattgtccccccaccagcccaccccactcccaacctcgacattaatttcccctgattcatttttcatgcctttgaattctgccttttcaaagcagaatatgtttctgtagctgtttctcatacctcccttcccctcatgaatatttcaaatgcaatagtgatatgatcgttcaaccttaagaggcacaccaactttatcttatttatcttaccgagctgcttccgatcccgggattaagtccaaaacatcctttgagagtttgtttgagttgttttccctcaggctgttgctgctgtgtatgtaaattacaaagagaagcagcctccccctcccctcagccccagccccgggcaccagcccccggcccgagacgcccgccctccctctgccaatccttcctgggagatgcaagacgcgctcctctcaaagccaattggcaggcctccggacgggtccctgccagggcatgtctccctgacttcctccagtggtctcttagaagcccaaaactcaccatgcgaccttgggtagggcgttccgccactcaggcaagtttccccatctacaaacaaggggaatagacacggcgaccctaaagtcctttcagctctgagactccatgtcacgtgatgtaatgtaacagacagagccctacctggttccaatccaagctctactactaaacgagtgatgagatggctcaccaactgtacctaccactgactagctgtgtgacccttaactaactgtacctaccactgactagccgtgtgacccttaactaactgtacctaccactgactagtggtgtgacccttaactaactacacctaccactgactagccgtgtgacccttaactaactgtacctaccacagactagccgtgtgacccttcactaactgtatcaaccactaaactatccatgtgtcttttaattgtatctaccattgactagtcttgtgacccttaactgtctgccactgactagctgtgtaacccctaactaactgtacctaccactgactagccgtgtgacccttaactaactgtacctactactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagccatgtgacccttaactaactgtacctactactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagctttgtgacccttaactagctgtacctaccactgactagctttgtgacctttaactaaatatacctgcctctgactagatgtgtggcccttaactaactgtatctaccactaaactatccatgtgtcttaaactatccgtgtgtcttttaactgtctaccattgactagctgtgtgacccttaactgtgtctaccactaactagctgtgtaacccttaactaactgtatctaccactaactagctgtgtaacccttaaatctatcactaactgtgtgacccttaactgtgtccaccactgactacctatgtgacccttaactaacagtatctaccactgactagctgcacaacccttaactatgtcaaccactgactagctgtgtgactcttaactgtttctacaactaactgactgtgggacccttaattgtgtccaccaccgagtcggtatgtaacttgtttctaccactaactagctgtgtgaccatgatgcgagttacagaagttctcagggtctcagtttcctcccctgcagcatgcattggttaacagcagctgcctctggggctgtagtagggtgaccagccatcctctttggtttatctaggaccgaagtggttccaggtatagggaacgctcagtgtcaaatccagtaagtgctaaagccaacacaagtttgtcacccaaggttgtagtgagaactaaaggtgaatgaggtgacatggataaaatctagcacatcaatataagttagtgtcattactattgctattgctattgctttttgtttgtttgtttagagatagagtttcactcctgtcacccaggctggagtacaatggagcgctctcggctcactgcaacctccgcctcctggattcaagtgtttctccatactcagtctcctgagtagctggcattacaggcacccaccaccacgcctggcaatttttgtatttttagtagagacggggttttgccatgttggccaggctggccttgaactcctgacctcaggtgatccacccacctcggcctcccaaagtgctgagattacaggcgtgagccaccatacccggctgctattgttaacggttctgctcatggctataaaggaattttttttcacttctaattttttctagaatttcagatttctctttatcaaagcagtacaagcaaatgatacaaatgacttgaaatggaaaacaaagctgtcttaccccagcccttctcccatcaaatccctctccccaaaggcaggcagttgaagtcctttttagcgactgatcttttaaggctgactctgcctcagtcaccctctgttcccactacttcaggccctcaccacattggccaggctggtcttgaactcctgacctcgtgatcctcccacctcagactcccaaagtgttaggattacaggtgttgagccacagcaccaggtccatcggttttcattaccaccacctgacaggtgagcaggctggttcacactctggtcacctggcatggcttgtcacatactggtgaagctgtcacccgcaaaatccagacctgggactgaggaaagagctaagcgatcctaaagagatacagtctctcaggtggcccttgatgggggcaaagagaggaagggacagttcctcttttatttgtccattcacacatgttgggagccaggcattaaatttgcaagccagaaaaggcaggaaaaaccaagtttatggcttttcaagttggttcagaaattactgtatgggccctccaaaaggtttaatgtctctgtggtgtcatcccaaagagaagcacagagaagcaagaggatctgcagctgaagagcccagaggcaatgaacactcaccttgactctcttctcatttctgaggctctatcagttaaggttcttagtttgcaagcaacagaaccaaatcttttttttttttttttttttttttgagacaaagtctcactctgtcgcccaggctggagtgtagtgcacgatctcggctcactgcaagctctgcctcttgggttcaagcgattcttctccctcagcctcctgagtagctgggagtacaggcacacgccaccatgcccagctaatttttgtatttttagtagagacggagtttcaccatattggccaggctggtctcaaactcctgacctcgtgatctgcccaccttgacctcccaaagtgctgggattacaggcgtgagccaccatgcccagccaacagaaccaaatctttacattaaaaagcggggagcttacaggatcagagaaagaatagagttcccagacttgagggggttccagttggaccatctttgtatggtggtggatctcaaccctcactgcagccaacagtcaaccaaagagacttttagaaaccactgatgctgggccctcaccctcagaaattgagatttaagccgggcatggtggcttatgcctgtaattccaacactgtgggaggccaaggcaggcagatcacttgagcccgggagttcaagaccagcctgggaaacatggcgaaacctcgtctctactaaaaatacaaaaattagctggatgtggtggcgcatgcctgtagtcccagctactcaggagactgaggcaaaaggatagcttgagcccaggaggtggagattgcagtgagccgagattgtaccactgcactccagcctagatgacagagtgagaccctggcagggcaaggcagggcaaggcagagcaaggcaaggcaaaaaggaaagaaactgagatttaactggctcaggtctgtcttgtttcacacctcccctaggtgattctaaggtgaggttgaaaaatgagattcactactctcgggatgcaactgcaccgtgagtccagaaaccagcagtactggcatcaccatctccagtagagctcgtcagaaatgcagactctctctcagaaccaccccagacctttcgagtcagaatctgccctcgaacaagatcctccagttagcgttaagcagattaaaggttgagaagcactaggctgcagggtcatggaatgactggactctaatcactctacatccttgatgatctctccttaagatgcaaattcccagaaggcaggcatttgatgggccatgcttttgtcacaccatgatagaagatctgggcataagaaattctgcagagtggtcccaccagacccacaggcaggagaagggccgtccctgaacggagtgggatgcggggctgataaatactacataggttaagcacagcgaccttcacagttcagagatagtgatgccaactaccacttattaagcacctactgtatgccaagcacagtgccaaggactcaaattactcatggaattccccctataaccatgaagccaatattattattactgctacagctactactactattattttataaaggaagaaactaaggtttagagcagtagatccaactttagcatggatcagaatcacctggaagatttgtaaactcacagacttctggaacctaccctcagagttgctggttctgtaagtctagggtaaagcctgagaatttttatttctagcaagttcccagatgatgctgatgctgtttgtccattcacacatgttgggagccaggcattaaatttgcaagccagaaaaggcagtaaaaaccaagttaatggcctttcaagtcagttcagaaatcactgtacgtgcccccaaaaagggaatgccaaacattaggcaagtccccatcttcacaatgagaacttacccacctcagagagatggtttccccaggaaacaagtgcagatggcattttgcagaaagtgcacattgaaagaaagcaaactggcttagaaatatggttaatgggaattctttggaattcatagcatcaggagagagtcgtttccttctaccacacacctggctgggagggtgacaatgtccttaggagggagagactgggaaacattaataccagagccctggctattatttgcaatgtatagcaatgtttttcctcaaggtagatctttggtgagctgtacacagtaaagctagccattcaggtggaattacatccaactagtcatctccgtcatactaaaacagtaaacaatgcttgaagaagtcagatgcctggcatcaaatctaagatccaccatttactggctgtggtcattaggcaagatgcttaacgtctttgttccttattatcctattttgtaaatgggggaattataataatacctaatctctaggttactggatggactaaatgaaataatgtgtgaaatttttagtaacatagctagaatattacaagctcccaataagtctattgtattagtccatcctcacactgctataaacaactggccaagaatgggtaattgataaacaaaaggggtttaattgactcacaacaggtctgcatggctggggaggcctcaggaaacttacaatcatgacagaaggagaagcagacatcttcacaaggcgataggagggagaagtgagagcacgggaaaaaactgccacgtttaaaaccatcagatctcatgagaactcactcactatcatgagaccagcatgggagaagccgcccccatgagccaatcacatccctccttcgacacatggggcttacagctccctccctcgacgcgacacctggtgattataattcaagatgagatttgggtggagacacacagccaaaccatatcacctattttatttatcataccattattgttattattattattggtggatgtgctggtggcgttaatattgttggcaaaactggaactagctggatctttatcaataattgcaatcatgattctgacatctgaccctttcatgccactggtaggcatgtaaacaggcacaatttttctggaaggtcatttggcaatatgtatcaagagccttacaaatacgcacccattttgacccagaaggtccactcctagaaatttattttaggggagtacatccagttgaggacaaagatgtatgcccaaggaagccatcacattattgcaaatggtaaaaaatgaagtgtcaaccaacagaaaaatgtttctgaaattacactatgttcgtacaatgaaatcttcttccaattattaaaataatgttcatgccttttaattggggtgattgtataattttatatctttataaaaatatatgtatgtaagacttcatatagatgatgaactcaattatgtaaacatatgatagaaaaagagaagggaataatccaaaagccatctgctctgggtcttagaatgggaattcttatggttttgtgcatttttgcagctatttctcaatagtcccctttataatcagagcaggctgggtagaatctggtacaggagattgtggcaaactagataattaacccagagaacattatttctgtctgggtatgccattaagttacaaagaccttttgtaaatgtgggtaataatgaaaagagggctatagtgttggaaaggaagacaggagataaggaggaatgaaaaggagtaggtattatttctacagagtcttgaaagattaagaaaaatgaggcagccagatgcagtggctcacacctgtaatcctaacacttcgggagatcaaggtgggaggattgctggagcccaggagtttgagaccagcctgaatgattgagtaagactcccctctctacaaacaaaatttaaaaaactagccaggcatggtggtgtgcacctatgctcaggaggctgaggtgggaggatcacttgagcccaggaggttgaggctgcagtaagccgtgatcacaccactgcacttcagcctgggtgacagagcaagtccctgcctcagaaaaaaaaaaaagaaagaaagaaacaaaagaaaagaaaagaaaaaatgaagcaaaagataccagcagcattggctgagccctagaggtaatgggaagggttgatggggcaagatcagagacttctgtgatgtttccatttgatgagacaaaactcagcattagcagaattaaagttacctaatctctagattaggaaagggaacagagaaatacctcatggcaacacatggcctttttgagttgcaagttgacagaaactcaagtcaaactggcttcactgagaaattcactctaggtgagatctgtcatcaggttggaggggatacaggctgttaggcagtgtgatcggctttccttctcctctctcagctcggctctcctgtgatttccttctcaggcaggctctcccccagggtgatgagatgaccaccagcagctcccggtttccaccctaccaggtttgcaaccccagcaaaaagagaacccctctttccctatccacctaacagaagtcctgccactgatgctctttgaaccaccttaaaggcaggtttctgaatcaatcacaacagccaggagaatggcattctcccatctgccaagcccagtctctcgagtcacccaaaacacatgggctgagaatggaggagaggtcccacctctcccccaaaaaagtgagatactggtctaagaaacagaaaaacgaagcttacataggctaaatgaacccagaagcactatgtggagtttttccttccagaacatgaaccaagtactcaagttacccccagatggtatcagaaggaaggattcaacagtgcccttaaaaaagggccatagttctcaaccaggggtgattcctcctcctcccctcaggggacatttggcaatgacaatggggcagggggttgtgctactggcatctagtgggcagagtgtagggatgctgctacacaccttacagtgcacaggacaaccctcacccaaaggattatctagcccaaaatgtccacagtgctgagactgtgaaacccagaattaggatgaccttataagttatcgcccaaaccagaatgctttcgagacaggcaaaaccaggaaagcagtcgtaacagggactgttgcagcaaatgaggacatatggttaccctactctcaacacaccgtccaaacagaaggcaaagccattctcactgaaggctgtgattcaagggaaacgtttcaatgctccccaccccaatcatcaattacaggaccacagagatgctcttcccagccgaggcttgtctttgaccccttctgctctctcccacttccggcatggctgacagtccctcccatctacttctaagaggtcactaaaaatcgaccagggcttgccagcctagtggggttgcccaaatgtctgcccacagatgccgcttcgaaaagctgtctctggcatggcccctactgcagcggcgcgtgacagactgccttgcttggtggaaggaatcccaccccaattaaattgctggagccctgctgggaaggaggtggaggcgggaggagaaggagagtagggagccgggcaagccactcctgcctctcctttttcatctcggaagagccaatttcaagcttgcctcgggtcataaaagaaattaatttgattctctcaaccttgctcagagtggacacacgtcttcggctggagcatctgctgctgctggatccagagcgaggagaccatcccctcgaaacgattccatttctgttgcaaggcagggccaaaatcatctgcctggagctggagaagcagctgcctggaataccctgggctgtcatttttgctggtaagatcgaaaaacggttctcacagctaaggtgactcccaagttgcaggaggtttacccagagagatactcatgggtagggctggttcttggaaaactcccaaacagaatttagcagtggcagctgcctaacccacttcatattgatcagcttgatcacactgagtcctcttaactgtcaggcatggcccctgggctgtattcctgattgcacacagctaaggtgactcccttgtacaagcctccccgcctgagagaggatggaacttgtgacctgcttctaatcaacagaatatggcaaaggtgccgaatgtcactctcttgatcatatttcatcaaataagatttccccttaggagacttagggactcccttgctggctaggaggaagtaagctaccatgttgtgacagggccatgtcaaagaatgcaggtggcctctagaagctgatagaggtccccagctgacagccagcaagaaaacaaggcctcagccaggtgcagtggctcacacctatcatcccagcaatttgggaggctgaggcaggaggatcgattgagcacaggagttagagaccagcctgggcaacatacagaaacctcatctctaccaacaatttaaaaattagccgcgcgtgaaggcacctgcctgtggtcccagctacttggcaggctgagatgggatgatcccttgaatctaggagttaaaggctgcagtgagctacaacttaccactgcactccagctcgggtaacagaacaagaggctgtctcaaaataataataataataataataataataataataataataataataataattttatttaaaagaaaaagaaaacaagaacccagctttacaactacaaggtaagtcaccagcaactgccatgaggacccattgtctaaatcttttaatgtaaaataaaactacattagaaaccacacaaaccaaatgtgtagcttcttcagcctttccttatttttctaaggttgtacaaaactattgtatttacaaaaatggcacaaaagtgaattcagcagtcaattcacatgcatacttccctcacatcttcaacaacaaaaggtattctaactccaactctacagagcttggcagttttcaggagtactggggacggattttgcaggatatatctctgtattagtccattttcatgctgctgataaagacatacctgagactgggcaatttacaaaagaaagaggtttattggacttacagttccacgtggctgtggaggcctcacaaacatggtggaaggcaaggaggagcaagtcacatctgatgtggatggcagcaggcaaaaagagcttgtgcagggaaattcccatttttaaaaaccatcagatctcataagactaattcactatcacgagaacagcacgggaaaaacctgtccccatgattcaatcatctcccaccaggtccctcccacaacacgtgggaattatgggagccacaagatgagatttggaacacagagccaaaccgtattagcctccatttgagtttgtctgatttttttcttttttcatgattagactcaggtcatgagtttttgcaaagaataccacagaggtgaagtgcccttcttttccaagcttgtcactcatccatggtgtggttcaaactttcccttgtctgtgatgttcctgcaactagttctagacttttagactgcaataatctcattataaggtacagagctcattcaagaaggataaggggcatattgatttcctaaggatgattaacaaaacagcacaaacgaggtggcttgaaacaagagaaatttattctctcacaattcttgagggaagaagtccaaaatcaaggggttcacagagctgtaccccgagcctctggggaagatcccatcctttcctttcctggcttctggtaaccataggcattcctgggcttgtagcagcttcacttcaatctctaccttgtgctcacttcggcagcacgtacattaaaatggaacttcaatcgctatccccattgtcacaagggggtcttccctgtgggtctgtgtccaaatttcctacttcttctaaggacaatctcgtattagattaagggcccaccctactccagtatcacatcttcgtaattacatctgcaatgaccctgtttccaacagaggtcacattctggggtactgagatgttagggctttcaacatatctctttggagaacacagttcaacctattaaataaagcatcccacaaaaccaaagtcagaaagcacagcagggttttgggatagaaagatagcaggagtcaacacagcctgtctctgtctttctgggagctcccggtctgtccttcctaagtctgtattgtgtcctcaatctcttctttctttctctctctctctctctctcactctctctcccccatcttctcgctccccatctccctctctccctctctctctctccgcccccccatgtattactctgttttcacaatgctaataaagacatacccaagactgagtaatttataaagaaaaagagtggtcacggactcccagttccacatggctttggagatctcacaattgtggcagaagacgaatgaggagcaaagtcacgtcttacatggtggcaggcaagagagtgtgtgcaggggaactcccctttttaaagccatcagatctcgtgagacctattcactatcacaagaacagcatgggaaaaacccgccccacgattcaattacctcccaccatgtccctccgatgacatgtggaaattatgggagctacaatttgagatttaggtggggacacagccaaaccatatcaccctgcatatcagttttttctattgcaattgtccacaggccaaacatgactatattgtcaccaactttctatccccctctagtttcaagcaccttccagagataagctcagagattttcaactccaaatttctgggagagagtccacatggcctggctgtaatcccatatccaaccccttggtacacagccatggccagagccaaaagaatcctatggggttctggatctcctagggctctgggaagggcaagtttctgaaggaggaatgggggtggacaaaaattattggctgagaaaatagctggtgaacgagacattatttctggtagggaatgaatgcaagaggccactatgttctggagcacagagaaaactcccactggattctcaggaccgtctgagaggagaggaatttgaaagcagctgaattatcacaggagaaacagaatggagtcagaaaaattctgctttgtggcacttagatcaattctatgtctcatatctttgggagcatgggtggtttcccccaccctccattttcctcttctctctgaacaaaagttttagtttgtgaagtcaaatctcatctttttttttttttttttttttgagacagtctcactctgtcacccaggctggagtacaagtggtatgatctcggctcactgcaacttccgtctccaaggttcaagtgattctcctgcctcaacctccagagtactgggattacaggtgtgcaccaccacaccttgctaatttttatatttttagtaaagacagggtttcaccatgttggccaggctggtcttgaactcctggcctcaggtgatccacccaccttggcctcccaaagtgctgggattacaggaatgagccaccacacccagcccaaaccttgtcatttctgaaatagagtgtcagggtagtgtcttagttagcttgagctgctataacaaattataatagactgtgaagcttaaacaacagcaatttatttctcacagttctgggggctgggaagtctgagatcagggtgctggcatggtcagggtctggtgaggactctctcctggcttgcagatggctgccttctcactgtgtcctcatgtggtggagagacgggtatcatctctctcatatctcttcttacaagggcactaatcctattcatgagggctccaccctcatgatctcattactttccaaaggcctcacctcctgataccatcacactgggggttagacttcagcctatgaatctgagggcaacacaaccactgtctgttagttcacggcagacagtgaaatagtggaaaggagggtgtgattgattctggggagggctggtgttgaactctgactgcaggataaagccctcattggttctctgggccccggtaactgcccatctccccaagagggttcccacatccatttcctcccactctgggagtgagcccagcccagcatttcatcaacaactgatctcaggagccaaaagacacagggagagtatggtgatcagggagctgaggaagagggtgaaaaaaggcaaggggtgccaagcaactcaaccagcacttcccctccatcttctgctggatttgctcctttgtctccccagcaggtaggagggattgtccaagacaaagcattggttaccatctttctgtgccaaggctctgggagacaagactggattgcggtcttccttccttattgtacttattgtctaaccttaaggtacttccttatggtaccattttcacacgctgataaagacatacccccacaccccagactgagtaatttataaggaaaaataggtttaatggattcacagttccacatggctggggaagccttacaatcatagcggaagacaaaaggcacatcttacatggcagcaggcaagagagaatgagagccaagcagagggggaaaccccttataaaaccatcagctcttatcagacttatttactaccatgagaacagtatgggggaactgcccccatgattcaattatctcccactgggtccctcccatgacacatgggaattatgggagctagaattcaagatgagatttgggtggggacacagcaaaaccatatcacttattctgtaggaaatgacttccaaggcattctccacccctgtctacatctgacagatagaattatatttaactatatattagtatattactatgacaataataactcatttattcctcacaccaaccctgtgctatccccgtttaaagatgagaaaacagaggcacagaaggtttgagtattatgcccaagatcattcagctgataaatgccatatccatctaactccaaatcccttgtggttgtacagtcagctgagctggcttttggataaaattggttggaggtgaatagagagaatgggttgggggaaagtggtggatgcccccagcaggtgtctcagaaataatgtgttgtcattttcactgtgaatatctcaggctcaagaataaaattacttttctatataatgatttgcaatagtcatgattctttatgatgaaaatataacccaaatcaaacttgcctaagcaaaaaaatatatatataacataaaattcaccttcaagggatggggctggagttacccccggaagcaagaagaaaaattatgcagagcacctggtatatccatcagagaccaccaatgtgttcctgtcactccaacaggaagcagagaacccaaggctgtgttggcaagtagaagaccctagggacccagagggcccagagagcccagggattcccagtgcaaaccctcagatgccttggtgccttaaggaaaaacacactagcctcatgctgcctaacttcagcaagaaaaaaaaggaccattcccttaatacaagcctcaattgccctgatgccttatggctgttattttagagaattataatgccacctatgattaataccgcaatgtggtcacacagcaaacgctcataagtaacctcccagcataaataccaagaaaatccagacttaccacggcttcatatacattttagatttttgctaaattggcccttgataaagcgtgtggccaccttaatcacagaaatcagcttcctccccaggcctaaaattagaagccccaactgccagtcgttaggtacagagctcaatgcctgctgagattcccctctcatttatcttctgcggggagcatttcaagttatcgccagctctcgtatcagctggcccggggaagggcagcaggcagcgagaggggcagctaacataggaagaggtcagcaggtgaggggtggctctggaggcggtggaactggctggtccctggaaagcttcccgctgcaggtctagagtggagaactcggactccaacagggaagactgtggctgggaagaattacagaccagatccagggctggattctgaatttagatggggcccgtaacaatttgcctaaatgatttatttcaacaatcaacacatccatatgctcagccactcagaatgatgactgaaataaaaatgaaaggtaacaggctgggcatggtggctcacacctgtaatcccagcactttaggaggccgaggtgggaggattgcttgagcccaggaattcaagaccagccctggcaatatagtgagactgcatctctacaaaaaaaaaaaaaaaaaaaaaagagcaagagaaagagagaattggatgcatgctataacagcctatgatggtagatccagctggtctggggaaaaaggagagtatccaactaggcttccccaaggtcatgaatttttttttttttttgagacagtctcactctgtcacccaggatgaggtgcaatggtgcaattacagttcactgcagcctcgaccttccaggctcacatgattctcccacctcaacatcctaagtagctgggactacaggcatgcagcaccacatgcagctaattttttgatttttttttcttttggtagagatggggtctcacttcattgcccaggctggtctctaactcctgggctcaagcgaacctcccacctcagcctcccaaagtgctgggattacaggtgtcagccatcatgcctggccagatgatgacatttaagctaagactaggacaatgaggagttatccaggtgtcaagtgagaggaatgcatttatacagagatagtaacatgtgcaaaggccctggggtgagaaggagttccatgtgttgaaggaattggaatgttgggaggaatgaaaagggtgtggcaaaatatgtgggctggggagggaggcaggggctagctcaggcaggatgagataaactctggtaagggttgtatgtgctcacagaaactcattaacacttcactgaatgctaatatttatttatcaggtttcagagtctgtttgttcgtgaggggagggttttccatcttctccacttgaatataaactccttgaaggcaatgacctttggttcacagttctatcaccagcacctagaacaagaactagaacaaaggcaaataaagacacccttatcaggcacaatgttgcaaagacttagtggttatcttccaggagccagtgaagggccagacctttcttaggaatgtgcaggatttgaactccccagacctgctgagtcaactctactgcaggggaccatacagagatgagaaagatgcgacattctttcacttctgggtagcagagtcaacaaatggaaccagggtgcccccaacgcccgttacctatgacatcttcctctgaaataagctcaacagaagatggtccctggctacagtgacttttgtcagggatctccaagaccgccctcaggcccattgatttgccagaaggacccacagaatcaggaaagccattgtcctcatgaacattgtttattgcactaaaaggatacagattaaaatcaaccaaggtacaagatgcataggtctctccaagagagaccaggggtaagtttccagtagttttctcccagtggagttagaaggatagctcctaatgctctgtattagtctgttttcatgctgctgataaagacacacccgagactgggtaatttatgaaaaaaaaaagaggtttaatggactcgcagttccacgtgactagggaggcctcacaatcatggcagaagagcaagggagagcaaagggatgtcttacatggcggctggcaaagagagaatgagagccaagtgaaaggggttctccttataaaaccatcagatcttgtgagacttattcactgccatgaaaacagtatgggggaaaccactcctgtgattcaattacttcccactgggtccctctcacaacacgtaggaattgtgggggctacaattcaagatgagatttgggtggggacacagccaagctataagagacaattagcaatgtatacaaagtactgccagccacagcagctcccccaagccttggtgtccaggggttttatcagcatttcatcacccaggcatggagcacctgcatgggtgacttttgttactcagtctccagcccctctagaggtcaaactgacacatacaaaaacaggcactcaccataaattgcattgttagcatggactagctagctcagcctgaggccataggtaaacaaagacactcttatcaggcagaatgttccaaagacttggcggttatctcccaggagccagtcaagggccagagctttctttggaatgtgcaggatttgaactccccagaccggctgagtcaactccttactgcatggggaccatatagagatgagaaagatgccatattctttcacttctgggtagcagagtcaacaaatggaccaggctgaacgaagacagtcaggtagaaccagaaaccacctccacctgcacccctgcataggacctaaaaaaatgtcataggaccatgacaacttttttgagacagggtctcagtctgccacccaggatgaagagcagtggtgcaatcatagctcactgcagcctcaacctcccgggctaatgctatcctcccatctcagcctcccaagtagctgggggcatgtaccacatctggctaattttttgacttttttttttttttttggagagatggggtctcacttcgttgcccaggccggtctctaactcctgggctcatcaggagttagatgatcacccagatgaacaacagggacctcatccctccccaggggtcctggggtaggaccctcagcagatgagaggagtagctctcctggcccatacccatgccctgttgtggtgtttataagcctgtcataggtcaggtttctagagagacaagctgtgggatggagatctgggtgcagggggtttactgggaggagcacctgctggaaagcaaggaagcagcattgggcagagaggggagtggcactgtggaacagtcgccaggacccctgagacaccccctgtgatggttaatactgagtgtcaacttaattggattgaaggatacaaagtattgtttctggatgtgtctgtgagggtgttgccaaaaaagattaatatttgagtcagtggactaggaaaagcagacccaccctcaatctgggtgggcaccatctaatcagctgtcagcatagctagaatataagcaggcagagcagcatggaagggcttgactggctgagtcttccagccttcatctttctctcgtgctggatgcttcctgccctcgaacatcggactctgagttcttcagctttgggactcttggacctttgaccacagactgaaggctgcactgttagcgtccctacttttgaggctttgggaattggactggcttccttgctcctcagcttgcagatggcctattgtgagagctcacctggtaatcgtgtgagtcaatactccttaatcaactccccttttcatatacatctgtcctattagttctgtccccctagagaatgctgactaatacactcccatatggaggggcaagggacagagcctttgtaaccctccaggattatgggatgcctaggaggggaggaggatttcccagcactaggtggcttcctacaggtgccttcttgccagaggcaggactttgctatgagctgttagcagccaggtctcccagcagctggggggacagagggcctcggtggtcctgcacagaggtctgagtggtatagcaccgacagcgaagctagtgaccaaagtggaaagacagagatatgaaaatctttcaactaattaagatttaaaactcagattgatgtgagaatcctgaattgactgtttaccaaagagactaggttttaaatgagaagggtctgggtttacattgacttggcaagactgagtgtcctatcactggagtgacaagggaggctggtggggatggatccagggaaaagaagcaaagtatggaacaaagaagtttagaataaagaaagtggccaaggctgggcgccacagttcacacctgtaatcccagggtggccaaggcaggaagattgcttgagcccagaagttcaaggctgcagtgagctatgatcatgccactgcactccagcctgggtagcaaagcaagaaaaaaaaaaaaagcaagaaaggaagggagggatggaggaaggaaggaagggagggagggaaagagagagagaaagaggaaagaaagaaaaagaaagaagaagaaagaaagaagaaagagaaagagagaaagaaagaaagaaagaaagaaaggaaggaaggaaggaaggaaggaaggaaggaaggaaggaagaaagaaagaaagaaagaaagaaagaaagaaagaaagaaagaaagaaagaaagaaagagacagacagaaagaaagaaagaaagaaagaaagaaagaaagaaagaaagaaagaaagaggcatcaaacctcacaggttgaggtaactgtaaatacacggtagtttatccctgagcacaaaatctcaatggcacagtcaaagccccaaagaagtaagaaacaaacatcatttccaccttttgggcctgaagaagcaggtacattagagaagggcagccacaatatctgtgaacagtcattaagctctcagacacagcatcccaccttcaccaatctgatctccttgatgggggtgatgctccctccaagataacaaagaaaacctggccaggcacggtggcccgcgtctgtaatcccagcattttggaaggctgaggcaggaggattgctagagcccaggagttcaagaccagcctgggcaacatagtgagacccccgtctcttaataaaataagaaaaaagaaaagaaaaccttccttttacatgaaggcatcataccttaaatgcacatcctatctgcccaggaggcccacctctagatttgtatcctactgatgaacacacaccaagatggacatactagcataaattgtggagaatgacagaaaatatcctgaatgtccaccatgagggaactgattaatttatacacatccatatactggaatactacacagctgataaaaagaataaggaatgtctatatggactgctatgcaaaaacctcaaagatatattgttgaatgaagtcaagatgcagtgtaatatgtacaatgggctatcatttataaaaccgggaggagacatatatacatatgtttttctatataaagattgtatctctggaaagtttcaagagaagccagcaacacttgtgaccttggagaagaagaactggtggttgggatggaaaacaaacttaattttcactgtatactttttctggtactgtttaattttttttttttaccatatgcacacgtttcctattcaaaagagaatttttttgaataggaaacaatgaaaaatcttgtaggcatacaaactaaattaattagccatccctatagcttcaacatgcatttcaatttgcaagcaccctggcctccaagattgattgattggctgtaaattgagaacctcagcaatttcctttcacagggacagatgttgacattgttcctgtgatttttcacagatgtttgccttccagcatctttaaaatcgagttttctgtcaatttggaaatcccaaatttctcatatcaaatcgagatgtcaggaaaatcaaaaccgttatcacattttgaaagagtttatggatggcaaatgacactgggaagggagatgtttaaggagcagctgacgtctcttaaccctttctcatcacttcctgcctcagtttacctaagccagaaaaaggggaaatttgattcaatatacagacaagggctttagagtctgcgtagctgtgcgatctcactttggctccaactctctagctgtgatactttgaaccagttcattaacttgcccagcctcctctctctcatctgtaaaatggggataatatccccagccttgcagtgtgattttacaattcactgatgcaaaaatggaaaatgcgtggcacttagcaccacctaaatgtttttttccttttttttttcccctttccctcctccttcaccaatcctccaagcagcttttcttccttcttcacgtccccattttgctcacgagattccaagatttacccactgaagctctcatgagattcccagatttacccattgttgagaaatcagaaacatcccccaccccctagaattctcctgacctgtgtcccctccccttaggactctgctctccctcagtggcaacaggcaggaatatgatctactcatacaaaccaaacctctgctgtttgtacatcttagctaataatgcccaacacgcagccaacatttactaagtcaggctcttgagagccacttcatctgcatgacgccacaaaatcctctcagttattatttctgttttagagatatggaaatgagcaccagaggtagatgtaacttgacaaatatctgggtggtagatctggaaatcaaagaaccctgaaccccaaccacagacacatgttcagttcaggctgggtctctacgctttgttatttttaacggggcattacgctccctggatggctatgacgctgcggttaactctgctcttgtggatgaatgcaattatctggggagctcgcacttataagatgtacagctatgggcaacctaaggcacatcgtggagtcttaatttcctcatctgtcaaatgagaatagcaaggatggcagggagggattaaggagcatttttggaaaaggaagtgctatgaaatgaacgtttgtgcctccacccccaaactgatatgtcgaagctgacaccctaattaccagtgttacggtatttgggtatttgaagatgcggctttggtgattatgtttagatgagatcataagcctaaggtcctggagatgcgatgtgtccatattagaagagacaccagagatatctttctctgtctctcactcttgcttgatctctccctctctctctcgcactctctctcatgctggcgtgctctctctctcccctgtgaggatacaacaagaaggcttccaactgaaagccacaaagagggccctcactggagaaacaaatcacccagcaccttgatcttcgaattcccagcccccagaatagtgaacaataaatgtctcctgtttaagccacgtagtatgtggtattttgtatggcagcctgagcagactgccacagtagatggttggtccttcctccaaccaataatagatggcttgtcctttccatcgcccaccttgggcaaggcaaacaggacagtgaaggcaagcacatctcacagaccccagcattcatgtgctaatgaggctcactactagtattggaaagatgggaagtcaaacagaattatgtccttgcgaacatacaataacttggaaaattttattgaaagacattaagtttgcatacacacaaaaatgagtgaagagttttttgttccattgaataatttagaggacatgtaagagaacacaagtttgaaatcttattatattttgtataatgatacataataatttccatgataaagctgatgtgtattgaggagatcatatgtgccaagcactcactgtgtgttaagcatattctattcattgtatcatttaatcctcaaaatatgatcaccgcctgtattgattggggttttccagagaaacagaaccaatgtctaaacagagagagatttcacgcaattatggaggctaacaagtgctgtcatctgcagggcgaggcagcaaactggagaccccagagaactgatggtgttagttccagtcctaaggccagcaggctcgaaacccggaaagagcagtgtttcagtctgagtacaaaggcagaaaaaagccaatggtgcagtttaaaaaccttcaggcaggaggaattctctcttacttcggaaaggaccgacttttgctctattcaggtcttccgtggattggatgaagtccacccacattaggaggggcaactgctttcctcaatctgccaatttaaatgacaatcatcccaaaacgccctcacgaacacacccaaaatgatgtttaggcaaatagctgtgcacctgtatccctaagagttaacacataaaacctaccaacccatcactctttccaaatagaaaaagtgaggctcagagaggttaagtcacttccccaaagtcacagagcttcttataagtggtggagggtttgactgaggacccatgctctattgtaatcatagaaaatcctagtggaattttccaatagaataaaatgcctgcccagctgcagccaaacgttccatagacaatgtctctgggccttttgtggcagaaaaaccaacataaggaaaagaaggccggagacgccagttttatcaaactcccataaggtaaagggaaatatctttctggggaaaggagactaaaggagaaaattaacagccacttttcagggagagagaaagagcagggacccagcccctctgagactgtgggctgggtgtggcctgagctgattggcagctccattgtaactatactgtaaaggaatgactctaccgaaactgagctaaaggagagtttgaagcatttttaaaaactctgcccaggccaggcgtggtggctcatgcctgtaatctcagcactttgggaagctgaggcaggcagatcatttgagatcaggagttcaagaccagcctggacaacatggtgaaacctcatctctactaaaaatacaaaaattagctgaacatggtggtggacacctgtaatcccagctacttgggaggctgaggcaggagaatcacttgaacccaagaggcagaggttgcggtgaaccaagactgcgccactgcactccagcctgggtgacagagcgagactctgtccaaaaaaaaaaaaaaaaaattctcagacaaccagcagtgatacaagagataaaaggcatctggctttacgctgcaaacaaaacggaaacaggaagtgagagagcagttggcctctaagaagcatccatttattttaccctgccaggtgcctacaaggtgatggttttgcctcccaaatataatcaggggcccaatctctgcattcaaagaagtatatttcagcaacccataagtaatccaaaagcagttccccacacatcagctcaaacagtgttacagggcaggcattcttggtgccatcagatccaatgtcccatgttttaaccaacaattgaaaagccctcttttttttttgagacagggtctcactctatagtccaggctggagggcagtggtgggatcttggctcattgcaacctccacctcctgagttcaagcgattctcgtgcctcagcctcccgagtagctgggattacagatgcgtgccaccatgcccggtacattgttttttttgtatttttggtagagacagggtttcaccatgttggccaggctggtctcgaactcctgacctcaaatgatccaccagcctcagcctcccaaagtgctgggattataggcgtgagccaccatgcccagctgaaaagctctcttttctaccctgaaaaaaaaaaaatgtgctgatcctataacccatctactcttctaaccaatcacaattgtgccctaattataataaaaaggagaaatgaaatgatgaggatttctaatgaaataatatatagagaaatgatttgggtttccaccaggaaagacggagcgaagcagtcaagtgctcacacacgtgtgtgtagaataaccagtgacagtcacaaacgcagacagcgtggtgtgttgtcgcatcggctttactgagagtgccatgttcttcaaaagagtggctctttcttgataaattcccataccaaacagagtcaaatcttctcttgatttacaccatagctgctacattcttggaaacatcagtgttcattcaacacttacatgtaaaatagaacatgtaaacatataaaatagaataggcagataaaatagaagaaggttggaccgggcgtggtggctcacacctgtaatcctagcactttgggaggccgaggtgggccgatcacaagatcaagagagcaagaccatcctggccaacagggtgaaactccgtctctactaaaaatacaaaaattagctggacgtggtagtacccgcctgtagtcccacctactcgggaggctgaggcaggagaatcgctggaaccggggaggcagaggttgcagtgagccgagatggcaccactgcactccagcctgggtgacagagtgagactctgtttcaaaaaaaaaaaaaaaaaatagaacaaggttatagactctgataatcatggttcttctaacccatatgaatttgggatctacacatatatatattcaaaaaactaccccacaccgtaatgactcccccatccctatcattagggcaaccaaaagctctctgcagatttaaaacacacacacacacacacacaaacacacacacacacaaacacacacacacaaacacacacacacacacaaacacacagacacacacacaaacacacacacacacaaacacacacacacacacaaacacacacacacgggacaattcagtccccagtgagaacctctgtaataaaaggtccaattcctaacctgcaataatattctttttttttttttttgagacagagtctcgctgtcgcccgggctggagtgcagtggtgcgacctcagctcactgcaagctccgcctcccaggttcacgccattctcctgcctcagcctcccgagtagctgggactacaggcatccgccaccatggccggctacttttttgtatttttagtagagacggggtttcactgtgttagccaggatggtctccatctactgacctcgtgatctgcccgcctcagcctccaaagtgctgggattacaggcgtgagccaccacgactggcccacaataatattcttaaagtcccctttcccgcctcctcagttctcccacaattcccagtttccccagaacaaaccccaagagatttctctgcccttccccccacccccaggcagagatgtcttccaactcttccccagcactgtaactctccactctggtcaagtggactccaccttggggaaagaatgtttgtaccgggcaccaaactagactttggagatacactagttcttagtatctgctagtatctgctactgtgataattaaggtaattatttagaccaggaatctgcaaaatacagcctgaaggccaaatccgagctgcctgttttcctatggcctgaaagctaagaaagaatggttcttacattttatattattattattattattattattattattattattattattattattattttgagatggagtctcgctctgtcgcccaggctggagtgcagtggcaccatctcagctcactgcaacatctgcctgccaggctcaagcgattctactgcctcagcctcctgagtagttggaattacaggcacctgccaccacacccggctaatttttgtatttttagtagagacagggctttaccatgttgtccaggctggtctcgaactcctgacctcaggtcatccgcccacctcggcctcccaaagtactgggattacaggcatgagccactgcgcccagctagttcttacattttaaatagttagtgggaaaaagacaaaaggaataatacgtcattacatgacaattatatgaaattccaatttcagagtttataaataaagtattgtctgtggctgcttttgcactacaatggcagggttgcatggttgcaagagagcacatggcccccaaagcctcagataatccactatctgggcctttacagtaaggttgtcagcccctggcttaggcactaaacaggtgctttcaagcacctactatatgccagacactaaagtaatagagaggggagacaatcaacaagaagcattctttctcaaaagttttaggctgggcacagtggctaaagcctataatcccagtactttgggaggtcgcggcaggagggtcaattgaatgcaggagtccaagaccagcctaggcaacatagtaagaccccgtctcctcaaaaaatgcaaaaaaaaaaaaaaaaattagttgagcatggcagtgtgtgcctgtagtcccaggtagttgggaggctgaggtgggaggatcacttgagcccaggaggtcaaggctgcagtgagccaagccatgatggtgcaatggcactgcagcctgggagacagagtgagaccctgtctcaaataaataaataagtaaattaattaattaattaattaaattaaaagcatgttattcagaatcacatagacttgggctcagctcttcagccataagcatgtttcttttctctttttctttttttttttttttttgttgagacagagccttgctctgtcacccaggttggagtgcagtggcacgatcttggctgactgcaacctccacctcatgaggtcaagcgattctcctacctcagcttcctgagtagctgggattacaggcacgtgccacgatgatcggctaatatttgtttttctttctttttttttttttttttgagacggagtttcgctctttttgcccaggctggagtgcaatggtgcaatctcagctcactgcaacctcctgccttccgggttcaagcgattctcctgtctcagcttcccgagtaactgggattacaggcgcatgccaccacacctggcctaatgtttgtatttttagtagagacagggtttcaccatgttggccaggctggtctcgaatgctgaacctcatgatccgcccacctcagcctcccaaagtgctgggattacaagcgtgagccaccgcgcccggcccatgagcatgtttcttgacctcagtttccccttctgtaaagcatggtgtggattgttcacctcgcatgggcatgtgaatatcaaatgagacatcctgtgcaatgtgcctcagacaaagaaaggagatcagcaaataatatttcctttctagttcatcctctcttcccatgtatgccaagaaagcaggcgagattgagtgagggaggtcatatcctctttgtctaaatgttttcttgttagagaacatctttcttcttaacatcccttcctacataaagaatctctgtcagaggaatattaaaaggccctaacctacagttagatggaaggcgagactccgatctcacagctgaatcactttagtctacctctctacccatctaatgttacccccttcaaaaataataataataatatgaaagttgggaagtggaaaaccatcctctggagttttcaaaaactaattccgttgtaatcatagaagactgaaggcaggattcatgtcacatttctcttcctcctgggcagatgaatctacaatttgtatttgattttaaatgtgattctcctgcatcttcagtgggtttgattgatagagcacatggggccactcagtaaaatgatacagtggagatcaaagccggagagataatttttgccaaaatgtctgcagccgacagtgagttataagcctttgtctcccactttacggaacacaattttatttaaagccgaaatctgtcactttggtattgtttattgaaatgcatcccataccacggtcccgtgaagaacaacgtcaagtcaaaaggtaaaaaaatccaatggttacaaacagcccaggaccaaataaaggagggagaatgcttccaatctgcataaatattacccaccagtgatgcatttggggcaagcaatgaagtcattcatctgcaaagtaaatatctggcattgtcagaggtgcctgacacagccccataaacccagtgagttctgttccattcagcagctcacacatctctatttgataactttgctttatttatgggtccacaatgggagtcataactgggtttttatctttgcacaacttttttactttattttttgagacagggtctcactctgtcacccaggctggaagtgcagtggtgtgatcacagctcactgcagcctcgacctcctgtgcccaagcaatcctcccacctcagcctcccaagtagatgggattacagaaatgcacttccacaccttgctaatttatattagtttttgtagagacgggctctccctaggttgctcaggctggtcttgaactcctgggctcaagtgatcctcccacctaggccttccaagtagctgggactacagatgcacaccaccatacccagctaatttttaaattttttatagaaaaggagtctcactatgttgcccaggctagtctcaaactcctggcctcaagacattctcccaccttggcctcccaaattgctgagattacaggtgtgagccactgtgcccagcttgcacagcttttttaaaccttttttttttttttgcattcattcacgcttttcatacatcatgattgaggatctaccctgcagactgtatggagttatctagaaggcaggaaggcagagaactaaaacctttggttaaaatatctggggttgagctcagtgtttcctgctctccagctatgtgaccttgatcgggtctcttcacctgtctgaacctcagtttccccactgcaaagtggagagcaaatgagaccatggacttggaaatgcttcatacatttctgagtgcctcacagatatgaagcccaaagatagcaccattctaggctctgtcaggacaatgaggccaaagttgtcactgatgccataaagttgtctctacagcgaaaggtccctggaattagcaggaggcttttgtggagcaaatgcctccttttctgcgtagaaagtgagatgcctcaatcactctgcctagatgcctctagatgcctcaattcctctgccaccaacagactctgtgacattgggtcacttttgagattcctgggtcctgcctacttcaccagaatgtcatgttctggaaccttctcagtctccaacctcatcactcacaagcttttcttatgctttgatagatgctacgattgcttgtcaaaaaaagagcctctcttctccgttgctaagagaaccccaatttttaaagtattgaacagtcacatgctttaggagaagttgcccttctgagcctcaaggagtgaatcttgactgacctaaactaatcatagtaatactgaccccctgtctagtgattgctttcgaataggcacgtgacccattgtgaccaatgagagttgatggaaatttcctccttgctgtcaacaatggacacaaggaagacacattttctcctctgacctttggacattgaacgttattgtgttaggatgtgatgtaaggcactgtggcacccattttgtgctcattagaggaaaagactggaattaagcccttgctctgtaagtcagagcacaaagatggcaagagcccaggtctttgatgatacaactgaactactgaataaaccaaccctagactcacctacccccaaattccttttaatgtgagagaataatgtcccatcttgtttaagcaatttcaggtttccattacttactaatgaatatatttggattccaagttgttatttccttgcatggaatgcttctgacacaactcacccttgctagcctcaagggtggtggccgaactggggagggtccaagaggaattgcaaaaaacagagctgcaaggagcagccttatctctgaccgctgtggtgagccctccactttgtataccctcccccaaccgtgtgactctggatcagccaatcaggtgatctctcttggcaccttgactcatgatgcaagaacacaggccctattgggtttccatgaattctctgcagggagagcaggggtccccagatcagcctatccctaacgcatgcccttggaggagttgccgctataaagctatctggagtcaccttgtatggggtgttttccaaggctgggccttcagcagtgccttcggcatgttctctttctttggtaagagtcagtttctggggtgaacaactgagaactcagggacatagacaagaaatcatgtctcattcttaaaagcctcagcacaagtcctggcatagagtaagtgttgaagggaggttggatgaatgaataaaggagtgagaaagttaattgcttcccttctctgggctgctgtatcaatcaaggttgtggcaggaaatacatagtaaactcaaatggggtaactaaaaagagtttagcaaagggctatatatagctgtataagtgggattaaaaaaaacaaaaacaaaaagggaggttgcagtagccctaactagcagcagtgaggagccatttctacccctagacctggaggggaaatagttatggaacccaaggagagtagccacagtcttcagggaaagacagctgcctggcaggagcttccaacctatggcaacccaacaggaaggagccacagaaataaatatccgaatccctctctcctcccaccttctagtattctatgatccccaccccattggccaaacccaagcagccacaagaggatgggagaccacatgtgatgtagtccatagaagtcagcctcctggggtacaaagcaggaaatgggggtggacagtggatgtaaaggagcaaatacaaaatatccggcacagatattgctatggtttgcatgtgttccccaaagttcaagtgctggaaacttaatccctgatgcaaccgtgttgagaggtgaggccttcaagaggtgtttggatcatggggacatcatctttctgaatggattaatgcctttatcatgggagcgggctggttttcacaggagcaggtgctctctctcaccctctctctcacccatgtgatgccttgggtcacaccatgatgcagcaagaaggccttcaccagatgtaagctctcaacctcggacttcccagcctccagaactgtgagccaagtaaatttctattcattgtaaattacctggtctgtggtattctgttatagcagcacaaaatggactaagacagatagtatctagtgataggatagactacaagaatctctttcacccagatcctgcagccacaaaagggccaacgctctttggagagtttatctctcacccaagcagccaccagcatcatcagcaaacagcaatgttcctctacacgcttgtgtgtttccttcattggtacaagtttccaccattgttttgcttataagagaaaccattctccaaagcccagagtaattatagagcccagaagtcttggggctttctgaatttgaagcagattcagggctcaagagagccaagaagtcatatcaatgccaggaatctggaccccaggcagacagcgtggataacctaccccaacagaggtgcaggctctcttcctttcacccaaaaaatagcaaacacatttattgatcaccgtgggccctttccttccacctggaggttagcaggaactttcaaaggtttagtgtcatccatatcccattgtcttcttcatgcacagaaaagagaaacttcttcatctctggaaaggagacatggactcacactccccttattctgaatttttgcccactaagccatttcacaggaagttagccatggtttgtggatttttaaatgcttctgggaggagaaggatttactagtgataagaaataaaaatgcaaatgttttactgatgacatatgcatgtaaagtgcttgatataatgcctgacatggaaaaaacactcaataaacgttagtcatcagtatttatatcatcattccttttaatacacgccatcgactgggtgcagtggctcatgcctgttatcccagcactttgggaagcagaggcgagaggatcacttgagcccaggagtttgagacgagcctgggcaacataagaagaccccatctctataaaagaatctttaaaaattacctaggtatggtggcatgtgcatacagtcccagctactcaggaggctggggtgggaggatcaattgagcccaggaggtcaaaatgaggctgcagtgaaccatgatagtacaaaaaaatagttagaaagaatgaataaggccgggtgcggtggcttactcctgtaatcccaacactttgggaggccaaggtgggtggatcatgaggtcaggacttcgagaccagcctggtcaatatggtgaaaccccatctctactaaaaaatacaaaagttagccgggcgtggtgacaggcgcctgtagtcccagctacccaggaggctgaggcaggagaattcctggaacctgggaggcagaggttgcagtgagccaagatcgcaccactgctctccagcctgggcgacagagcaagactccatctcaaaaaaaaaaaaaaaaagaatgaataagacctactatttgctagcacaatggggtgactataatcaaaaacaatttaatcgtacattttagaataactaaaacagaataattagattgtaacacaaaggaaaacgcttgagatgatggataccccatttggcctgatgtgataattacacattgcatgcctacaatatctcacgtaacccataaatatatacacctacgatgtagtcacaaaaactaaaactaaatataaaacaacaagcatttatcatctaattgtctggatttggaacccacaagccaactcagctaagtgctctggcttagggtctcccatgaggctgcaggtaagatgtcagccaggactgcagtcatctgagcgtttctggggctgaagactaggcttccaggctcactgtgtggttgtctctatcccttactggctcttagacagaaacctcaattcctcaccacgtgggcctctccgtaaagtgccttagtgtcctcaaaacatggcagctggcttcctccaaagcgactgatccaagaaagagagagaaagagccaacaatggaagctgcagtctttcatgacgtaatcgcggaagtgacataacatcacttctgcggcattggtcacacacgagccccaacatggatctttccagcgtgggaggggactaaacaaggtgtgaatggcagcaggcagggattgttgcgggccatcttgaaaactggttccctcagaggagagctggaaggctggggacaaggacacaagagaggcttttttatttttttatttttttgagaccgagtctcgctctcgctgcccaggctgaagtgcaatggcgcgatctcagctcactgcaacctccgcctcccgggttccgggaattctcctgcctcagcctcagcagagttccccaagggtgcctgttggcctagtttgagactcttggctctgttagtgggagtctcaaactatgctccaggctgctgattgttctgagggatttctctctctttctttctaacactaagaaataggaacttggcctcccagagtgctgggattacaggcgtgagccaccacgcctggcctgtctgtaatctttaaaagtaatagcatattagctctgagggtcggttggattttttttttttaaacagttggcagtcatttgtagccaagtcaggtgaaaagggtaggtgatcaagctcattacaatttttattgaaataaaatttatctttagtaacgagattgattttttgtgtgtgactccggagggcagtttgcccagagcagtggttttcagactcttaacaaactatccctgagaggaaaagagaatgaattcatactctgtggagtgtagcccaaaataacctctgcaagggtgaaattttctttgaagtcttattttaccttaggtatttgtgaactctgcgttctattttgtgccacatgtgttttaagttactattactctgctaaagtttattcatcctccaggaagatgatgatgtttgtactgtagttttttatgtcccagggatacagcagggttccccaagggtacctgttggcctagtttgagactcttggctctgttagtgggagtctcaaactatgctccaggctgctgattgttctgagggatttctctttctttctaacactaagaaataggaaatacagttttcagtttaaaaataacataattaaaaagtgtagaaaagtctctcttggccgggcacggtggctcacgcctgtaatcccagcactttggaaggccgaggcgggcggatcacgaggtcaggagttcgagaccagcctcaccaacatggcaaaatcccatctctactaaaaatacaaaaattagctgggtgtggaggcaggcagctgtaatcccagctactcgggaggctgaggcaggagaatcgcttgaacccaggaggtggaggttgcagtgagctgagaatgcactactgcactccagcctgggtgacagagtgagactgtctcaaaaaaaaaaaaaaaaattacaggcaaaagaggttgcccatgttctcatcattggcagcagcagcatcaaaatatggcacccactccagtgatgcctttccagaaggagcaacactcatgtgaaaccaccagctttgctttgttttggttgttgctgttgttgttttttcagagagagtctcactctgttgctcaggctggagtgcagtggtgggatcatagctcactgcagccttgaactcctgggctcaagcgatcctcctgcttcagcctccccagtagctgtggctacaggtgcacaccagcacgccttgctaattcaaaaaaaaaaaaaaaagaaaaagaaaagaattgtagagatggggtctcgctatattacccaggctggtctcaaacttctgacctcaagtgatcctcctgccttggcctcccaaagtggcaggattacaggcataatccagccattgtccctggcctggcttttttttttttttttttttttaatgtagctcacgaccacaaacggagtttggtttccttgctctctctttttcccatttggtacttttctttctctcccatgcactcctcttcaaaccaaaagtgaatcttgttatttcttgaaaaatgtgtagatgttgaagggatgaaaaacctgaactctaacgtctgactatctgaacccaaattctagccgccccactcagttgctgtgtgactgtgagtaagttcttaccctctctgagcctgtttcttcacttggaaaataaaagtatacatatatatagctgttagccagaactcagcctagggtaacctttcaataaatattagcatcatcaaggaaatcacttgacaaattaattttcattaagcaatgagggtctataacagtgatgacttctgaccaaccagcccaatggctgacaaaggactgataacactttacatttttataatttccctagatttcaaattctccataaggagcaagtacagtttttataatcagacatagaactcgcgttcactctgctcatcctgaccctagccactggccaccaatttctgggttggctgctccaacctgagagcacagctactggaatcagaggcagaggagctcctcttgcgtttcgttgctggtttcccttggttttgtaaaaataaataaataataaaatagggatacacccttcagacaacaggtaacttcctaagctaagatgaacaggaggaaatttaaatgtctttctccggttcaaatcccctaccctctcccatctgcctaccctgggctccaacactcgggagaaagaccataagtcgttcagatgatgctttggagctggacaatcaatcgtgatcaaaaacaggggcatgggagcccggctaacgtggaaggatgggagaaaatcaggctgaattagagaagggtacattgtggagtgtgttttacaacgccattagttctaagcacataaggatttcaaatcaaggagcatccacacacacacaaactcttggattacttaagagataaggcggatccaaaattagcatatagatcagaggcatgcagttgagtgctgctaaagtgggctataaatgcttgggggaaaataaactagttgtttttctgaagaaagctttacaacgttccaaaatcttgtccaggaagtgtgaactctaagtccaatggactgaactgtgtcccctcaaaattgatatgttgaagccttaacttccattatgatggtattaggaggtgggcttttttggaagactattagtttagatgagatcatgaggatgaggtcttcgtgatggaattagcatccttacaagaaaagacaccagacggcttgctctcttgctctgtctctcctcttccctccctccctctctctctccctctctacctccgctccccccaccccccacttcctccgtcatgtgagaatgcagagagaaagcagctttctgcaagccaggaggagggtccgctgggagctacatcagccagattgtggcacttctcagcctccaaaactgtgagaaatagatttctgttgcttaagccatccagtttatactattttgttattgcagcctgatatggttcggatttgtgtccccgcccaaatctcgtgttgaatcgtaatccccagtgttggaggaggggcctgggggaaggggattggatcacggggacagacttcccccttgctgttctcatgacagtgagtgagttctcacaagatctggttgtttaaaagtgtgtagcactttcccctttgctctcttcctcctactccagccatgtaggacatgccagcttccctttcaccttctgccatgattgtaagtttcctgaggcttccccagctatgcttcctgtacagcctgcaaaactgtgagccaattaaacctcttttctttataaattacccagtctcaggtatttctttataacaatgcaagaagagactaatacacagcccaaactaactaagacaaacccactctgacccattctgacacccaaactaactaagtcctggtttgaacccttcgctattgtgtcaccttggggcaagtcacccaacttctccaaatgtttgtttcccaccaggaagatggaaatgacagtacctctccttcctaccccgcaagcctatcaggaggatcgaaagggacatggcaagcaaatactttctaaactgtaaagtgctgtgcaaacgcaagacagcattactctctttttatggagttatttatactctacctggttacagcagaggatttatggtagatgtcagtaaggctctttattttgaattttaagagagaaataagaatctttgttatctgtagagaaacaaatataatttccatggggcactaatataatataatataatataatataatataatataatataatataatataatataaatataccttaccgaataaaccctttgctcagacgtagtgaaaaggtaaattccccttcaacctaatgaagtttcagtcgctcacattttctgaatttgccgaacagaaatgcgatcaggtgcatactaagtgcagtacccagcatgatgtctagcattgaaacatacagtgtatacaccagcacctccaccaaacccatatccagcatgcaaaacatacccttttcaagtcggaagcacatagatagattttttggagttcaaaaggtcttaatgcaaactggctccaattcctttttttttttttttttaaatctttgaaacattggttaagtcttctcagagctatcattttgcacacatggaaactttagaccatccatccttcaagtgtcttggggtaattagagatactgaaggttaaggacctagcatactactaatagattttcaacaaatggtagctactgttatttctcatcattgcagatttaagagtgccaattctcagagcacttcagataaaaaccctacctttcttaaggcaaaaaacaacggcattaacttttttttttaattaacctaagttcccattatgtttagagaagagatcacaatgataaatgcttgccctgtctctcttttttaaaaatttactgttcttacatgtgacatatactgtggtacttagtgtcaccctacaaagaataaatttaaattgaagaaacagaaacacgggagagtccttgtttgggtttaatttgtatctgactacaataaaattctatcctggaagctagagtcataaaactaaaagtcaggaaggaaaagaatggctaattaagctccgaaactaaaagctctttccttattgctatttctttaagtcctaacaattggtcaggcacaggggcttagctgcgccattctagttaatggtcggttacaaatttccaccataaactcatcttccttctagcaacttaaatctcaggcactgggatgtaataaggagagaaagctcttaggcccagggcaatctctctcaatcccaatctccctttcccccatccctatcccaccacaataactgttagtaagagcttttggttgcatgcccagaaatctaactctggctaaattaatcaagaaacgaatatactggtttatccagctgaggtcatttacggaaagggagtgctaaggtttgaatgtgtctcctccaaaattcatgttgaaacttaatcctcattgcagtggtattaagaggtgaggccttttaggaagtgattcagtcaggagggcttggcccttaaggaatgaattcatgccttataaaggggtagagggaactaacttaggcccttttgcccttccaccttccacatatgaggatacagcattcatgccctccagaggacacaaggcaccaccttagaagcaaggaacagagccccttaccagacacaaaatgtgcctgtgccttgaccctggactcctcagcctccagaacggtgagaaataagtttctgtcctttataagttatctagtcttgggtattttgttacagcagcaaaaacagactaagacaggaagagaaaagaaccagagccccagggactagaaacaggactcactgcctcaaagtacatgtatactctctctctctctcgctctctctctctctctctctctctctctctctctctctccatttctcttcactgtttgtctttgctcagccttattctccatctctctccatgtgggagggcaagtagaggctggcacctccagatatatatcctctctgttcaagaaccacaataagttaatccccagggaagattctgatgcctgtgccactccaaggtccaacactgctgggtggatagatcctgatgtttgaccagatatgtgccacttaccaaccatagcagacactggcaatggccacccatgtcccttggaccctccccatcccatacaagctgaaggcatccctctgcaagcacctgcaactccccacctgaaggccttttctcggcctcggcaagacaggccagaagttcaaggatgtcaaagtccctgagagaatcccttggtcaatgtcagatgagtgatgaaagataaatatctcagttttctcaacactcaggtgggacaatttgaggtgtgttccatgccatcaaccaaagcccatcaaaaggaccaagccctggctccccatagaagtaacttactcattaccttgctttattctggtttagatttccttgtctcattttgccctgtgatggttaattttatgtgtcaacctgactgggacgctgagtgcccagataattggtaaaacattattctgggtgttcccgtgaaggtgttttcagacgagattaacatttaaatgggtagacggaggaaagcaggttgcactccagatgtgcatggtcctcatccaatcagttgaaggtctaaatagaacaaaaggccaacccttgcctgagtcagagagatctcctcctgcctgagggccttcaaactgaaacgtcaaaattttcctgcctttagactcaaactgaaacacagctctttctggatctcaagcctgctggttttcagactggaactacaccactgggtctcctgggtctccagcttactgactcatcctgcagatcttaggacttgtcagcctccataattgcatacacacacacacacacatatatataaaagtgcatatagatacatatatgtatgtgaatgtatgtatataaaagtgcatatagatacatatatgtatgtgtatatatatatacacacacatacacacacatatatgtgtgtgtacatatacatgtgtgtatatatacacacatgtatatgtgtgtatatatacacacatgtatatgtgtgtatacacacacacacacacacacacacacacacacacacacatatatatatatatatatatatgaagaccatagagaagtctctaagccaaagctggggacaggggaatcctgtgtctcctggggagaggtctgctttagtgtccctgccatgctcagtcattacccaggagcacctcatggaaggaagcatatggattccccatatgcttatatatgtgtgtgtgtgtgtgtgtgtgtgtgtatatgtatatgcatatgtgtgtgtgtatgtgtgtgtgctattctattggttctacttctctaaagaaacctgactaatacactcccattctcctactggtgcttcccagagtcaccctacaaataaaccattacatggaaatcctcatcacaggatctgcctctgggaaaacccagcctaagacatccatgactttcataggagaagaaagagctctagaattggcagccttactgaaccatgtggaagaggaaaggagaccacctaaacaaaagggtattaaccaattaaaataacctaaacccacacttgtccaaattgctgagcaagtgggatggaatggaacaactttcaaccagtgtccaaatattgctgtgactcctagactggcttgacacaaaggcagtgtccaccagctctaaacatccatctcaactaagatttctccaggaaggctagaactgacaccctctgcttaggttctcagtgacttcacccagccagcaaaggagctcttaggaaggcagacaagccctgaagtctgtctgctcagactccagctacctgctctattcctgctttatcaacctctagcttagtcgctcaatctccagctttgctccttcccattagattctatggctgaacctgactgccatagtttgtttctcagatgaatttaaggcaagggttgcaaactttaatgcacacatgggcagacaagtaacacaaatgagtgaagagtacagattagggcaactgggtctggtggagactgtggcaaactagagagcacacaccctatctaaggaggcagcgaggacttaattttgcaagatttgtggaatggactcccaatgttgccaaactgccactattttttaaagagaagcaggaaatccaggggtttttaaagatgtaaaatacacagtttgttgaatgctggcaactgatttttttttttttttttgagacaagagtctcactctgttgcccaggctggagtgcagtggcatgatcgcagctcactgcagcctcctcctcccacattcaagaaattctcctgcctcagcctcctaagtagctgggattacaggggtgcaccaccatacccagctaatttttgtatttttagtagagatgaggtttcccccttgttggccacgctggtctccagctcctaatctcaagtgatctgcctgccttggcctcccagaatgctggagttacaggtgtgagccacagcacccagccctgattttttttaatgtaaatactgtatgaacccagacaaatgttctgccaggccagtgctgcatggctcaccatgtggtggccctgagaatgggcctcatcgacctccctctactgggagtgtaattaaccagggccccagctgctgcgctggggaatccatatgcttccttccatgaggtgctcctggctaatgactgagcatggcagggacactaaagcagacccctccccaggagacacaggattcccctgtccccggctttggcttagggacttccctatggtgttcgcaccctaacttttttctcctctctcttttactcagagtcagacttgcattactgtctcaggttctcccagctttatgtggcaccttctttgctttctctcaagggcatttcccttaataaaaatcacatatgtgtaaacctgtatgggagtttgtttctcagaactgggctgacacaccatcttgcaaactctgctttcggcattcagctcacacttacttacaccctccaaactccaactatttagggctaattccattccagctcccaccccttgaatcccttcccccctccccccacttcctcctcccattctgctttcctggaaacagcatttccacttacttttgaacaatggtccttccttcactgttcattcatggagtttggatagcaccatcttctaaagctagagctgagcacatgatcaggactgactaatcaccctcttctacttccttagccacaataattcgttcagagatgggcacctgactcttacaatgcaatgagagtcagcttcttatgccagtgcttttggcaaaggtaggttcattttcccctgggattactaagctggtaggaggtaagtcagcagctgctgatggcataagaaaagggcctgataatgaagccaacatggatgaaaagagagctgagaagtagagatcagacagatttcaaagcatatcatttaagcatctggatccagccatacttgaagtccagtctatctgtgggctttgaagttgcatggaacaatagcaagatgtagctgagagagttttggctaatataccacctcacctctcattcagtttcatggaatataacagacattgccaactaaaatttacaaacagcattgatataaaagctccgccatttaaaaaaggaaactttctattctttcactgtgtggccttgggaaatttctaatccgttctgaacttcagcttttttccctctcaaatgtagcaaatacaacataacttgcttgccatggagggaaatcagatgcccttatctaggaaagtaaagatagaggtataaaacattgttatttcaaaaaaaaaaaaaatccagcacataagtctaggagcattgaacaagggtcagattgcatggattcagattccagctccattactaacaggctgtgtgaccttggacaactcaattgacctctctggccctcagtttccttattagtaagacggaaactccaatcatatctattgcacgggatagttgtagaaattaatagatacataagtgcttagtgcaacatgtggcactcaaaatatgtgtggtatgattgttattgacacaatggttgacccatgaatgattgtgatgccaaccccctcacagttggaaatccacctataacttttgactcccccaaaacgtagctactaatagcctattgttgaccagaagtcttaccaataacacaaacaatatacacatatgttgtattttatatgattatacactgtatttttacaataaaataagctagagaaaacaatatatgattaagaaaatcataaggaagagaaaatgtatttattattcattaagtggaagtggatcatcataaatgtcttcatcctcattgtcttcacattgaggagactgaggaagaggaggaagaggaggaattggtttcgccgtctcagaggtggcaaaaacagaaaaaaatccatgtataagtggacccatgcggttcaaatccatgttgttcaagggccaactgtatttatattacaataaatgctgttaatgttgtcactgttgacccttctagtccattcccaacatcacttcctacgcccagtggaaaattccatcttaaaatcacccagcccaagccctcttcagtagactcagatagatggcttgtcaagggcatgacttaacttctccaaacacaaccagcccagtttcaactgccatttggggaactttcccaattaccacatttccgcacatcaagtatgaattactttaattgccccagaagaacgcactgttgaaatatttgacttgcccagaactaattgtctgtcaaaaagagattttgcagccaagctgatctcttcattggacatctaatttaactgaaaacctttttccctgcttgttttatgctttcttctcctgtttttgccaaattctggatgctgggcactgctttcggaaataatttatcttgttattttctattataaaagtaatacatgttcattatagaaaaactgaaaaaaaaaattccaaatgaagaaaaacagttgatcctagactcattgcccagaggaagactatgaacattccacatgaagaaaaacagtggatcctagactcattgcccagaggaggactatgaacattccacatgaagaaaaacagtggctcctagactcattgcccagaggaagactatgaacattccacatgaagaaaaacagttgatcctagactcattgcccagaggaggactatgaacattccaaatgaagaaaaacagtggctcctagactcattgcccagaggaagactatgaacattccacatgaagaaaaacagtggctcctagactcattgcccagaggaggactatgaacattccaaatgaagaaaaacagtggatcctagactcatcgcccagagaaagactatgaacattttagcacgtctccctcccaggtttcctagaatagatgtctgtacatagttaataaaaacatatattcaagttttgcagctttttgttccactttacattttaagttgaacgtttacacttcccattccaagatcttcagaaacatgtttagaaacagaagagtatcccaacaacagtctgtttaacctcttcccctaatgctgaactattgttgctttaagaatacattttctgtgtgtgtttcagatgtagtttccttaggaaagattctctatgctgtgcaacaattccccatgtgtctcttacatttctgcacatcttgtgtcagcttttgttctagaccgtctttataaggatgtttgtatagctaatagcattagaagatagggctagtatagtagaagacagatttatttgctgattaggattataataataatatctctggaccaggcgcagtggctcatgcctgtaatcccaccaatttgtgaggctgaggcaggcagatgacctgaggttgggagttcgagaccagcctggccaatatggtgaaactgctgtctctactacaaacacttaaaaaattagctgggtgtggtggtgggcgcctgtaatcccagctacttgggagacaggtgggagaattgcttgaacccaagaggcaggggttgcaatgagctaagatcattccactgcactccaacatgggtgtgacagagcaagactctacctcaaaaaaacaaaaaacaaaaaaagaagaagaaaaagaaaaagaaaggattataatgacaatgtctccctccatccagggtaaaggttgaaaagaccaagattcctaaacttggggttcctcaggtgtgatgcaaatccactgcaggcacagattctacctggatccatccatgtattactcatttctcacactgctaataaaaacatacccaaggctgggtgtggtgtctcacacctgtaatcctaacaccttgggaggccgaggtgggcagattgcctgagctcaggagtttgagaccagcctgggcaacatggtgaaacctcatctctactaaaatacaaaaaattagccaggtattgtggtgcacacctataatcctagctactcaggaggctgaggtgggagaatcgcttgaacccgggaggtggaggttgcagtgagccaagaatgcgccactgcactccagcctgggcgacagagtgagactctgtctcaaaaaaagaaaaaaaaaaggctaggcatggctgtaatctcagcactttgggatgctgaggtgggcagatcacctgaggtcaggagttcaagaccagcctgaccaacatggagaaaccccatctctactagatacacaaaattagctgggtgtggtggtacatggctgtaatcccagctactcaggaggctgaggcaggacaattgcttgaacctgggaggcagaggttggggtgagctgagatcctgccattgcactccagcctgggcgacaagagtgaaactctgtctcaaaaaaaacaaaaaaacaaacaaacaaaaaacataccctagactgagtaatttataaaggaaagagatttaattgactcagggaggcctcgggaaacttacaatcatggcagaagggaaagcaaacatgtccttcttcacatggcggcagcaaggggaagaatgagcaaaagaagaaaaagccccttataaaaccatcagattttgtgagaactcattcactatcataagaacagcatgaagataactgcccccatgattaaattacctcccactgggtcccttccatgacacatggggattgtgggaactacaattcaagatgagatttgggtggggacacagccaaaccatgtcaacctgtgtcacccttgagggacttgggggtcaaagggaactggtgcagacatgaagctcaagcttcctgttgtgccatgaaaaataaagtcctttatctctcaatccagagtctcatgtcttctgcccacatccataaaactcactagcctccatgtaggataatatcttagaccagcacagttcttgacactctagaagtgaatttgttggatcaaaaagcatgaacaattgctaaaactcttaatatgtcttgtcaattagctctccaaacaaatgagtcattgcctgaaatctcttttgtcatcaggaagggatagagctgcttgactcagatctcccaggtggccttagaccgtaatgtcttcctttcgtgcagagctcttaccatcctaagccactactcctacctaatattctataaaaagctttttctccctacccagtgtctccaatgagctgactttcttttctggattactcttttatgtaataaaaagtagacatgagggtcaaagggaaaaaggggaatttgtttaatttctaccaagtgccaggcatagtacaaagaacatttagataaggcagaaggcattaattatttttatctacccagaaccccctgccccacctaagcaccccagcccctgacctggccacgtgggtggctatgtgacctgagctgaaccaatcagagtccttccctgggatttttttcacatcataaccacatgagaaggtctcccattatgaaacagagaagcttgttggcagccatggttctagccaaggatggaaaaaacaaccaaaaaaagaaaagaaacaaaaaaaaacccaccatggtaaaaaaatacatatataaaaataaaaaagatatgacagacagacagacatggggaatggtctctttccagttgcccctgccactcaactgctctcctaccttcctggatttggttatgagagtcaataaattatccccttttattgcctaaatgacttccatatgagtttctgctccttgcaaccaacataatcttgacaattaatagtagctagcattttgtgagtgtttactgtgccatgcccattaatacacctaatcctctctacaattggacaggtaaggtgcttttagtaacctccaatgtacaaaaaggaaaacaagttgggtgaagtgaaatgacttgctcacagtcgctgggctaacaagggggcagagtcaaagtttaaagccagagcccatactcttccctattgtataacacagacatgctgtctctgttcccagtgctggggaatgcagagaactggggactgaaggaagagcaggcgttcaggtaagcattaatcaggggaccttccacaagggaaaagggagtactggcccagttgaagtccagccagcactcagcatggtcaaggatggggtggtgctctctccagccattcaaggtgctgagaaaagaacagaactttcatctgaggaatacaagccttttaaattattaggcccagagaggcaatagaatgagatagcaatcatgtcctacataccccctttgagctcggtattcatttcttaaaactgcttgccattgccacaagtagctatcaattaatctaataatgccccactggatgctataacccacaccttatagcttaacaatgtatagccaatcactcgtcaatgttatttctgaaaaccagtgagaattcctgacaaccaactgtgtaccagcccactccatgtcccccttttttgcctttataaatccacttgtaactgctgctaattggagtgtatattcagggaaacttgaatctacgctccctggctacagtcctcaagcttggcccaaacagagtctttacttatattaattttgcctcagcttcttccttttaggttgacagtgctacaggctgaattatgtccccctaaaattcaaatttgaataaatgttcaaatatgaatttgaggccaggcacagtggctcatgcctgtaatcccagtactctgggaggccgaggtgggcagatcatcttaggtcagcagtttgagaccagcctggccaacatggcgaaaccccatctctactaaaaatacaaaaattagccaggtgtggtgacgcatgcctatcatcccagctacttgggaggccaggataggagaatcacttgaacctgggaggtggaagtggcagtgagccaagatcgcaccactgcactccagcctaggcgacagaacgagactctgtctctctctctctctatatatatatgaatttgaagcccttcaaccatatggatcatatgttgaagtcctaaccccctagcacctcagactgtcattgtatttggagataggggctttaaataggtgattaagtttaaacctatttagctcatttagggtgagctctaatccaatcagactcgtgttcttataggaagaggagattaggacacacagagagacaccaggtatggacaggcacagaggaaagaccatctgaggacacaccagaatcgaccatctgcaagccaagaggaggtctttggaggaaccaaccctgctgacaccctgatctcagacttccagcctccagaattgtgagaaaattaatctctgtcatttaagccacccagtctgtagtactttgttatggcagctccagcaaactatatctacagtaatccatcaccacttatgacaggctctgccacatagtaggtgtgtgtgcacacaccacacacaatcatgtttagaatatgaaatccgtgaaccctactcccacactgataacagttcaggaacagttgatttttcctcagggaatctggtttgttttcctagtttccatcccatcaagaccccttcccacctgctgggaaatacttgcctgaacccctcgttcctttcacaacacacacctgatggtaggaagaagcttccaactctgatattgacagggtgcttgtaacctagcaccctttctcctaccttgttatggaaaaataaatcctttatcctatttcaactacagtcttggcaaaggaaaaaacaaaacaaaaaaggaaaccagcctagaaatggaaaccaaagatcatgaacagtgctatgctgagttacagctaagggttggcctttctggagctggctgccttcagatggcagggctctgagagtgtgtgtgtgtgtgtgtgtgtgtgtgtgtgtgtgtgtgccagaagcacaagatgacacaccctgtggtggggtcaggcaagctgattgtgggaaaggtgggaacagaatattttacaacaatgttggaaaaatgggtttacgttctctgagaggaagatacccaaagcttcaagctcacctcaagggaaaattgagctaggttcccatgctctccacttggatctcacgcacatgaacacacatacaaccttctcctcaatattcacaagaggcctctgttgtctgcttctccagagagtggaggtgaatttacctgaagctaatgaggcttgggcttcagggtcttttccttgtacctgtctctttaaatgctggacttggggaaggctttaggtgagaagggaaagctgggtttcaataatgaagcacctctatgttcacatttctgattaattgcctacacagatcccagaagaatggaatggaaatagctaaaggctccagaattttctctttttatttttttgagacaacatctcactctgttacccccaggctggaggctggagtgtggtggcaagatcatcgctcactgcagcctctaactccctggctcaagcgatcctcccacctcggcctcctgagtagctgggactacaggcacacaccaccacacctggctaattttttgaatttttttttttgtagagatgggggtcttgccatgtcgcttaggctggtcttgaactcctgggctcaagaaatcctcctaccttggcgtctcaaaaagctgggattacaggcatgagctaccatgtccaggcagctacaggaatattatacttaatttctcattccaaaataacattctcttttgtgcctaattttaaattcataattttgtattctttttcttaaacagagatccccatattatataagcttcagtccccacaaaaactggatctggttctgccaaaatgatatatcctttatgatatttatagagacgttctgattatttctgaacatctcagactttctggaaccaagacaggttcgattatgaacatctgttgtctaattttaaagaccaagggggaagccgggtccttatgaaggccataaaggctccaagctagatggatattgggggagtgggttagcagagatgtcctaaaacaatgtattacactaatgggaagaacaaaaggtaagtctaatcacagatgtcttggttttcaagctagtcagacttcagataactgtcaaatcttcagccataaatcgaaagtggaggagaattaaagacccatccttgtttgcttacagaatttacttaatttagccactctatccttaattgatagcaacaggttttttcaaaatagccaaagtaatctatgctttgctacataatagcaaaagtaatagccaacatacatcaacacctactatgttatacccttgacaggttttcctattttagtagtcaaagcaatttcatggagtagcaattacagttgtaatttcactagtgagaatgcagagtgaggctcagagaggttaaggaacttacccaaggtcacacagctagtgagtggagagttggaatttcatctctctgattttaaagtctgggccctttcctctactgcctctctctgaactcaatgacacatcctaagtaagtaagggcttctacacaggatgggttagactatgctgcagtaacaaacaacccctggatctcaggaacttaaaacaaaatttcaggctgggtgtggtgtctcacacctgtaatcccagcacattgggaggccaaggccagtggatcacttgaggtcaggagttcgacaccagcctggtcaacatggagaaaccccatctctactaaaaatacaaaaattagccaagcatggtggtgggtacctgtaatcccagctacttgggaggctgaggcatgagaatcacttgaacctgggaggcagaggttgcagtgagccgagatcacaccattgcactccagcctgggcgacagagcgagactcttgtctcaaaaaaaaaaaaaaattctagaaataactccaaccttattttcttgaacacgactcatcctgaccctccagcactccattgatctgggctaaatatatggaatcctgcagatgaagacaccagcacccaaagctaatgggacacagaaaacagaggccactcaaataaatgtcagcactcctagttactgaatactctgtgtctggcaagtttcatcattagtcagttattcattcactcaatcaacaactacttactgagttaatatagcagcatggttatgagcacagactctggagcaagaggtcctaggttcaaatcccagttaccctgcttatcagctaaatgacttctcagtgccttggtttctccacccagaaaaatggggattataattaataattgcctacctcattgggttaagtggataaactaagaacagtggcatgcccatatgacatgctctataatttttattatcactgtgtgccaggcattattctatatgatggaggatgcagctatgaatagggcagacaaggtgcctgtctttacagagcttctattctagtgaaggagagaggctttattagcgagtaatccttgatcgagccatacctgaagctaactacacatccttcaaccttccaatttccccaggcattaagttcttttttcttttctgcctaggctagcttgcactgagtttctctcccttgtgaaccaaagtgtcctgaccagtacagaggtctaaagcctaagctctttccagtctgccccttgcccctttccagctgaagccctattcatttgcacccaacatcatcattgcgtccagtgcctcaccacttggtgagacccttgaatattcaaaccagcgtgtaagcagagagttaggaactataaacagtaaattataacaagcatgaagtggaagcctgctgctgatcattcgcaagagagcaatcaaatctgtcttggtgcctacatgttttatggaaaacatgtctatgttttaaaagtgtttttgaaataaaaaataatttactaactaaattagatttccacatgttttatctagttaacccatcccttatcataagaaacgtaacttcttattttttttttttttttttttttttttttgcgatggagtctcactctatcacccaggctggagtgcagtggtgtgatcccgactcactgcaacctctgcctcctgaattcaagtgatgctcctacctcagcctctcaagtagctgggattacaggtgtgcgtcaccatgcccagctaatttttataattttagtagagatggggtttcaccatgttgaccaggctggtcttgaactcctgacctcaagtgatccccctgccccggcctcccaatcatggtgggattataggcttgagcccctgtgcctggcctagaaagctaacttcttaattgcaagctactttcatcaatataatgcatttgtctcactccttaaaggactcctgtcacagtgaattggcaaagaactggtcagacacaagaggcagtggagtattagtaaaatacacgtggatttggagtcagaccttcctaggtttaaatgctggttttatcgcatactagttgtatgccttcatcggggtttcccaagaatcagaccctgagacaagactccaagagtaagtcatctatgtgggaggtaaatgaaacatgacacaggaaatgaaataggtcagggaggcagccagtaaagggcatattataaaacaagttaccacttgggacaataactggagcttaaacttgctggaaaactctaggatacactgtagaacatctctagcaatgtgctggtagatgtttaacaaccaacactgcagaaaaatattaaaagcccagatttgtagtgtctgcccatatccatggtgtaaatcctcccaccatggctgatttcacactaccttgtccctgaacaaggacttggggaaagatgcacataccagctcttgcttcatagttatctgacctaaggggtgagggagatggggtagttatccacttacaccaactctcatcagttcctggtggagggatgctcccagggcaggtgttgattcctccaagacttccaagccatcatacgggtgggcaaagacagtacaaccagaaaaagacctcagaaagagggccaggcatggtggctcatgcctgtaatcccagcactttgggaggccaagacaggtggatcacctgaggtcaggagttcgagacagcctggccagcatggcaaagccccacatctactaaaaaaaaaaaaatagctgggcatggtggtgcatgcctgtaattccagctactcaggaggctgaggcaggagaattgcttgaacctgggaggcggagattgctgcgagctgagatcacgccactgcacttcagcctgggcgacagagtgagactccatctcaaaaaaaaaaaaaaaagaaaagaaaaagaaaaagtcctcagaaagagaatgcaactacatttggatgggtcagtggatgcttaagaggtaaagggttagaagatacaagggaagcactgaaagcatctgttactctgtgcaattgtgaaaacgttatttcatttctctaggcttccaatattgcattggtaagatatgattcattgaatcttccaacaaatattcatggagcacttagtatatacccggcaatcttcaggccacaggaaacagaatgttgagttaccatgacaaagtcactgtcacagagccagtggggaaagcagcctctaaacatgccacccagtaagtaacaaagatcatttcaggaatggtgaggactatgatgttagagagggtgatgggagggagaataatgtagcggagaggacatgaacgggaaaatctttctgaaagggtaacgtgtaaggtgaggctcaacagatgagaggaaatgtgttgtaaaaagatctgggagcagcattccaggtggaggaaactgcatgtgcaaaggcccagaggtgggaaggagcttggcttgttcatggaaaagaatggaagccagtgtgtctagatcaaaatgaatcaggcagaaggtaaccaggaaacagagtggagaggcaggcaggaatcagtgtctgcagtgcgtgctcagcatcataaagggtttgagtagtaacacaaccctgaagagttgttaaatgagctcccatgcatgtaactggcattactcatgttattaacctgggaaactgtcacgtctcttacttttccatttaatctcatgcccatcctctttgctcacaggagccaagaagtccagtatctcactccacatctgccttctcgtggtccaacactctgccgactcagttaatccaaagatcacttccaaacttcaggctgatggaaacctgaggagtcggatccattcataggcagccccattttcaccttcccttgtccccgaggctgccattaggttgaaaaccagtctggtactgtcagcgtgtctttgtctacagctatgaaaaagtccacatagtccagtctctacatagggcacaatgattctcctctacatctcagctaccaggaaccagcttgtcgaacacacatgcaaacattcaaacccttctcaggttcccctctagggccttcagggacttatccggcatacctgaggttggggccattgcaatctattcttagtctagtgttaagccgggtcaacagcggagatgctccttctccttgaactaattttatttccagagtttcattttccttccctgcaacattaggcaccatttggggatatttttatccatccatatggatttcaaaatctcataaagaaggagctgggagaagaatgaggaatcactgattttaatgactgtatttgttgatctcttactccattcctggacccatgttgaataacataaatatatatgcatgtacacatgctatacatggtatctagatgctatatgtgttatatataacatacatgttacaatatatgttagatatgtatgtcatacatatcataatatataattatacattgtatattatatattatactattacatataatatataattatacattgtatacttgtatactattacatagtataatatatacttatgtttatataataaaatataatgtatatgaaatatacataatacatatatgatatattatataattatatcatataatatataattatgtatatttcatataccatatattttatcatacataaatatataagttatatataatatataatgtcatatattatataaattataattattatatattatataaaacatgtattatattatatataatacatggtttatatgttatataacatatataacaaattatatattatataacatgttatataacaaattatatattatataatatgttatataatataacaagttatgtaatatacaatatatgttattaaaatagatattacataatatattaaataatatatgttttatatattatattatatatgttttttatatattatataatatatatgttttatatatattatttttgtttttttttgttttttgggggttttcttgagacagagtcttgctctattgtccaggctgcagtgcagtggtatgatcttggctcactgcaacctccgtctcccgggttcaagcaattctcctgtctcagcctcccaagtagctgggactacaggtgcccacaaccaggcctggctcatttttgtattttctttagaggcaaagtttcaccatgttggccggactggttctcaactcctgaccccaagtgccccgcccaccccatcctcctaaaatgccgggattacaggcatgagccactgcatccagcctatatatgttctttcatcatcaccacatcatctaattttacagatgagaacactgaggcttggggagatattaaatgtcttatccagattgcatgcatgtaagtgacataagcatgatttgaaactaagcaatccaacacgagagtcctaggtctagagcctctctgacctgctttctacctagaaattatctgagttctttatgcaaattgatgcactttttcatccctttggtctcttgaagtggcagcttttgctgcacccagttctcacaacaacttgcaaagaggatcaacacacacgactgatcacgagataaaggaagtctgaagcagtccccaccaaacatgcaaattcaatgaatgaagatccatttcttgcagctttctgctttgcataataacatttggctgtgatgatctattatgacactaatccttgcacagcccagagaagatgggcaatagttttctggatgtcagtgggactctggcacaagggccagccaattttggtgagcgcaacaggaaattctttgcaatgtccttgtgaatctgaggttacaaagactggctcaatctgtcacaggaagcatgctggaatgcctttgtccttctttctagtttttctttctttctttctaataattctcagtgtgggagaatattattctttctaataattctcggtgtgggcttacatcctttgctttggggaaggtttctatcattagacctctcttttcccccaaccatccagctgtgaagcggttcactgcggacccaacctctggcatgactgtggatcagcagcaccaatgccatgaagactgcagacacactggagaaccaaggctaattcccttagccattgagcctccgctttccatccatgaaatgactctcaaaatgccagcttgggctattgcttgcttcagagcacctaagagcatctgaacaaaaggaatatctttttcacagatgtaaatgaggaaagcgaggattatacagtagaagaagtgctctataaggctgctgaagatcacaatttttttttttttgagacagtctggctctgtgtcccaggctggagtgcagtggtgcaatctcggcttactgcaacctccgcctcccaggttcaaacgattctcctacctcagcctcccaagaagctgggataacaggtgtgcgccaccacacctggctagtttttgtattttttagtagaaacagaatttcatcacgttggccagacttgaggtcaggtcttgaactcctgacatcaagtgatccacccgccttggcctcccaaagtgctgggattataggtgtgagccaccgtgcccggcctgaagatcacaattcttatctaactctgctattcattggctgggccaccttgggcatgtccattagctttctggttcttaggaccctcatgtctaataacaaggtctttcctacctgccccacagggctgttgggaggaccaaatgagatcaagaatgcaaaagctctctgtcaactgtgaaacactaccaggagtaaagattcacaaggcatgagttgccacaaggcagtatagcatggtggttaggaggttaagctcttaaaccagattatttggattccagtataaccccaggaaacttaactttgttttgtggtgttgttgttttgttggtgttgttgcttggtattttgtctaatttttagaaacagggtcttgctctgttgcccaggctggagtgcagtgggcatgatcatagttcactgcagccttgaactcctgggcttaagctatcctcctgcctcagcctgtggagtagctgggactacaggtgtgcaccaccgcacctggctaatttatttaatttttgtggagacagggtcttgctttcttgcctcagcttgtctcgaactcctgacctcaagcaatcctcccatcttggcctccaaaagagctgggattataggtgtgagtcactgcgcccagccaatttaaattctttaagtctcagtttttccatttgtaaaatgggcatagtaatagtacatttgtcacagagttggtttgtgataggataaggtgatgcatgttcactagaaatgaagagagaagggttatgattcattgaaaagaaagaaaaacctaggctgggtgtagtggctcacacctgtaatcccagcactttgggaggctgaggcaggaggatgaattgaggacagaagttctagaccagactaggcaacatagtgagaccctgtttctactaaataaataaataaataagccaggcatggtggcatgaaccctgcagtccaagctactcagaaggctaaggcaggaggatcacctgagctcaggaacttgaggctgcagtgagttataattgtgccactacactccagtatgggtgacagactgagatcttgtctctataaagaaaaaaagaagaagaggaggtagaagaagaaagtctgaactactccctgcaggaagagtagacaaggtaaagagccctagaaaagattcgtccccgtgctttcctctagaatgaggactccagtaatttataccagtgctggagcacaggcttgacaatggctggagctcagcctccacagtatctgttgtgattagtgctcaaaagcataaagcataaatggaactaagaagaaacaagatgctcaaggtctccccttcagccttccttccaagtaacagaatcatgatttgatgatttgaccccttcttctaccacctcaatattgaaatctgtttccaattcccgttaccttagagaacaccatcagatgtccattgtatatctcagattcatttctttccaaaaacgaatttaacttgccttccaaataattttactcctaatttttagctcactttctccatgaatatcatcaccattcacccagttacccaaaccaagagcctgaacaacatctttgagtccttctccatcacaccctacattcaaccaattgccaccttctcttttatatacctccttaagtcacggccttaatttgggaatgatcgtttctcatttggacttgacttcatggtcaaatatggcatccagagatctagccattgcatcctaattcaagaccaacaacaggaaaaatgggcaaagaaatatatggtcctcattctgagaaaatgtccatattactcttctctttgcattccttggccaaagctaaatcacatggcttgggtagcttcatgagagattgggaaattagagggttttggttttgttgttgttgtttaaagcagagtctatgtcaccctaattaaaatcagtgtttcatcttttattcttcctcaaatattcagtgttaaagtcactaaagggcaccaaccaaagtaagcatcaacgagaggggataggacagagatctggcatggggtgttgaagcctagaattggtgcacgacctagttctagtcacgaaaaagcatcagacaatccccaattgagagctcttatacaacataaatggcctgtatcttcaaaagtatcaaggtcaagaaagtaacaaagagactgatgaatctgccggaataagacgtgacaattaaatgctatgataatcttgccctgcaagattataaaggacattattgggatggtcagtgaaacctgaatggggcctttggattagatggtggtaatgtatcaatgttataataatttcctgactttaatggtcatattatgggcatataggagaaggtccttattgcaagacacacacagtaaagtattgggaaacgattcgaggagagggaaaacttaattgtactgttcttccaactattgtctcagtttgaaatttttcccccgaaaataaggtgttatttcagagaagaaaagggaatgtagatgtttcaatatgtaaatagtaggctccaccacagatggtatttaaataatgtatcagaagaggtcatcccaagggagtaatatttaaatccagagccaaagatagaaagccatccacgtgaagagcaaggagacaaagttttcaggcagaaggaacatgtgagaagtagctgaacttgttttcagagttataaccctagcaatatggtggaaaataacaaataactagcaatatggttgaaataaacaaactgctattccttcagaaacatgagtaagcaccactgtgtgcaggaacttgcagcagtcagctagatgctgtaagacaaacaaccccaaatcccagaaagagcttatttctctgccatgcccatatagcttggctggagcagctctgctggaggttgcaggtctgaagacatgctggggcggctctgctctagatgcatctcatttttctaggaccagcgaccaactaagtcatgtttttctcatagagaaggcaaaagcacaagaaggcaaactcatcacacgagagcatttcaagcctttcataagggttatgtcctctcacatcccattagccaaagaaagttaagctcaactcaacagtcgaagggtagggaagtacactatgccatctctcagggaaaaggaagtcacatagcctagctgaacatcaatgatgtaataggagagggaacaaatatttactaaacaatagtctcatctaccgtaaagctcaaatacttcacaaaagagccacccttagaaatagcttttatctcatctattttatgggtgagtggggaagaaggatgacaaagcccctttaagaattttatataccctagacacattcacttttggaggtctcaccagataagcatttgaaacatgctacaaatttgcctgtatcctacattaaatggaattttggctctaaacattttttgagaaaattttaaaattctgctcctgaaattatctggcaataggtgatttatttaaatttagattggatgtgatttcttggtaattgtgcatattcaggaggtctagaaagtgggaaattctaactatccacatttttcagatgtaatgaaatccctaggaatgttaaatttaacaattagtgatattgacaaagcagcacaatttgtaggtaattttttttttttttttagaaggagtttcactcttgttgcccaggctggagtgcatggcatgatctcggctcactgccacctccacctcccaggttcaagcaattctcctgtctcagcctcctgagtagctgggattacaggtttacaggcatgcaccaccataccaagctcattttcatatttttagtagagacagggtttcaccatgttggtcagcctggtctcgaactcctgacctcaggtgatctgcctgcctcagcctcccaaagtgctgggattacagtcgtgagccaccatgcccagcgtaggtaatttttaagatattcattaatttcaattttgtcattttctcttttgcatttttaagccaatgtgtgtgtgtgtatgtgtgtttgtgtggtgttttttgtttgtttgtttgtttgtttgtttgtttgtttttggtctcaaacatttctgtagatcttgaaaaacgtataggtcccgggaagaccctatgcctaacggattaaaaatgcacatgttgcctggaatcaaagctaattattattggttgggaaatggataccctcccactccagactcctcagcacaggaaaataagagcagctaactccaacagaacccaattcatttaggaggctctctgcctctgcataagggtgaatggtttgggattgctgctcagcagagcccttcatctcattcacgaagccattcacactgtatccagtccatttgtaaggcaaataaaaatgtcgtcttccaatcttggctcatttcatcttataagaaaagtctcccgtccgatgcctagccaacatttccctgttgtgattaaagaaacagcaggtaataaaagctggactaacggttggtcctctaaggaccaaaatatgattgaagaagcaataacttaccccagtgccgccaaggcaagttgtctcaataatgtaacaaagctatacttaatggcaacagagcacgtttcactgatactacaccataaactgcccgctttcaattagttgcatatgtattaaagggagtcaacacatatttacagcaatcatttctatgtatacaagatgccacaaaaatgtagctttctgctccttctggtcatttggccacataggaataatcaccaaccatagatgcaattctggaaaagtcattaatgctcatctctatggttgcaagagattattgggcttctatttcatgccaaggcactttacatatgtaaataatggtgcatgctttgaatgaagtcatgtttttgtgacctacaatccccactggctgctgcagcacctggcacatattagccactcaagaaattctcgttgagtgaataaatgaaacattcaatggctctgagaccctacctttcagattatcagcaccatgaccctgcttttgagacccctactctctctcccttccctattatctcttggtgaatattggggaatggctcacctgaactgccccacgatttcatgcctgttttcgccattacctgtcaccttacctggccacagtcattccttccaaagccactattcacatctctatcagatgctctgcagttctggggctcctgcctcttgggacaaggctagtactgtcataccaggtgtgatggttaatattgagtgtcaacttgattggattgaaggaggcaaagtattgatcctgggtgcgtctgtgaggatgttgctaaaggagatttacacttgagtcagtggactgggagaggcagacccaccctcaatctgggtgggtaccatctaatcagctgccagcatggctagaataaagcaggcagaagttggaaagaacagacttactgagtcttccggccttcatctttctcctgtgctggatgcttcctgccctggaacattggactccaagttcttcagcttttggactcttggacttacaccagtggtttgccaggggctctcaagcctttggccacagaatgaaggctgcactgctggcttccctacttttgaggttttgggactcagactggtttccttgctcctcagcttgcagatggcctattgtgggacttcaccttgtgaccgtgtgagtcagtaccccttaataaactccccttcatatatacatctatcctattagttctgtccctccacagaaccctgtgtaatacaccaggccagcagaagggagacatttgctttcctggacattttctgttcattttacatttgctcaatgaaaaaaatcaggttgcaatacatatataaatagaaaacacagagagacataaatattttttaaaaagaatcagaaacatatgccccaaaatgctaatatgattacatctgggtggttaatatttattttctgtttctattctctttgtgtttccccaaatttgcttgttgacagcacatgtgcattgcttttggccaataaatgtttggcttatttaaagagttatcttgatgatagccaggtgtggtggctcacacttgtaatcccagaactttgggatgccaaggtgagcagatcacctgaggtcaggagttcgagaccagcctggccaacatggtgaaaccccatctctattaaaaatacaaaaatcagtctatcttaaaaaaaaattagctaggtgtggtggcacgtgcctgtaatcccagctactcaggaggctgagacatgagaattgcttgaacctgagtggcagaggttgcagtgagccaagatcatgccactgcactccagcctgagcaacagagcgagactctgtctcgattaaacacacaaacacacacacacacacagttatcttgatggcagttcaggaacttgggagatgagggctgttctcctgaaaccctataagaaccctcaggtgggttatgccacccgttcactaatatcccatttacgggtgaagggaaaggtggaggagaccaaccaacccaccagcagtggcctcagtctcaaataaaacttagtccctgagttagaagccaacttaaccatggagaggaaagagttcatccgatgggactaaacctgctcacttccttccaagaaccaccccaagggttcatttcccaggcaccaggagccacccagctccaacatgctgttttctgtcttctggtgacttatcacttgttgtttcttcaagaataagccttcgttgttccaagtaaacatctcaaatgcacacattcttaaagtagtaagtcatgtatccacctgtgcatccaacaaattattatgtagtgaacacccatgagggacgtgctgctgtgttcaatgctggggacaccacagggggccacccacggacttggttcctgccatcatggagctctcggtccagtggaggaattagacatgaaccaaataaaacacagtcatgaatgtaaaaccagaaactagagtaagtgctcttgaaactgtcttagcaaaattatgactgagacagtgaaagagatttaacttgatcaattccatctttcttctaacctccaagctgtccttattcattcttgggtgtaggctgacctaactttgggagaaactgagttcatggttcatagtttgtagtttaaagcaaagatgataacagccctttcccaaagcagacctccttcttgcctggggactagattgcctttgttaggactaaaatcagccacaagattagaaactatggtttaggagtcaggcggctggaggttacaagattctgaccctccctaaactgttcctaagatcagtgcttgagataatttgcagaccctgcacgtgacgggtcaggtggcaccacccagatcgatcaactggctcatctgatcttgtggccccaacccaggaactgactcagcgcaagaggacagcttcgactccctatgatttcttccctgaccaatctgcactcctggctcactggcttcaactaaccacccctaccaagctgttcttaaaaactctgctccccaaatgcttgtggagactgatttgagtgataatcaaactccagtctcccacaatgcccctctgcatgaattactctctctgtattccaatccccctgtcttgataaatcagctctgtctaggcagcgggcaaggtggacccaatgggcggttacactctgtcgagaaggaacacagggagctgtggaaggcttccagaggaagtgcctgggctttgaagaatgagcaggcattaagtgggcaaaagagcatgtgcgagggtactgtgcaatgtgtcaccacccagggagagaggagaagtggactatgaggctggggacataaacacggtcctggccatggagggccttgtaaaccccatgaaggatgtttgctctttatcctaatatcaacatgaagtgattagaaggtagcaagcccttgattaaccaacaattctagatccttctccaaacttctcttttagggaaaggaaacctagaagtcaaaatataaggtggtgggatttcagttgaaaaggtgcccagggtcggcctcgggtcagtctatctttgggtctatcacaaacactatattaattgcccctattaatctttcatcatgtgccaggcattgtgatgatgtatactttatatccattggcacatgtaagcctcaccacaagatttagggcctatcattatgcccatttcacagatgaggaaactgaggttcaggggggcttgtaacatgtcccaaatggtgtagctagtaagtggcaatgccgaggctcaaatccctccaaagattctctctccaaaggtcattttcctttccctaagccatgctggtgcatctggggtcctggaaactaggagatgattttcagaattataagacttaggtcgtgcaagcttcttaatcatcaaagaaagtctggaaagagaagaagatgtttgcaggaagctgccacagaagagaacattttagacagaggaacagcatgaagaaccgaacacacgtggcatcccctaggggccatgaatatagcagggaggcaaccacagagttgggaagatccagagagaggcgggacagatacagtgggtcctgaaagtatgttaaatagagtcacagtgacacggcaaccaggagtggcaagggagccacagacacacatgattagacacaacaatcatgttttcaaggcacagcccacttagagatcacagcaagatgctttatccaatctccgccggcaatcagagcttgaaaaaggagcattgtcgtcaatcaacttccctttgggcaaaaggcacaggcaaaggagaagatacttcacccaccttttaataaatgtgtcttgaggagagagttggcccacagagtacggtctccaagatctaagactccacatgggtagtggcaggggagacaatgggaaccaacaggacattggctggaatcacaagtcacaccttcagtaaaccagaggagtcatttctctctcccttattgactctgggccctggagaaatgccacagaaattcatgagaagaggagttgaaggtagacggcacctggacattatttctgccagcccatttgagttcatctggtaaacattttgcatttggaagttgacatcgtttaataataactgtcaatgtcaatgatcaatgccatcataatggcacaaatacccttgtgggcttggggttgggaggggtacggtggggactgacttctttgtctcctgtcctttcaatggttataaataatgatgataataatttctatttgtgtagctttgtgattgcagagagctttaggcttcctgagagctttcacctatattacctcagctgatccctctacaatgtgcagtatctattttggtcccctctgggaacctgaggcttgacaaggtcaggaaaggccacaccatggcctgttcctgaaataggtgccacaaatgaaaatccttgcagagagtccaggcagataacataagtgaagaaagggaggaatgagaagcagtagggaatggtggggtctgtggtgaattggagtgcatgccccattgaaagacgggggtagctgcctatcttgtatccaccaactgtctccacgtgggaacatgggcccaatgctgtcagagcttctaataaattaagagaagctaaaagccagatgctatgtcagtctcccagtttttaaatgatcgcaactgggagtcttgcaactctgtctcccaggctgtaaggcagtggcacaatcctagctcactgcagcctcgaacccctaggctccaaagatcctcctgcctcagactaccgattagctcgaactacaggcatgtgtcaccatgcgtggctagttttcacaatgtttgtagaaatggggccatctcactatgttgcccaggctggtctcaaactcctgggctcaagcaatcctccctgctcagcttcccaattagctagaactacaggtgtgcaccaccacacctggctacaaactctccttgtcaccccctgttgacaggtctctttccttcacaggctgagacaactccaattcaactctgaatccccaatacaggacctgcccagggaacagggctcagacatttatgctgcgaaatactcagcttttggggctcagcgtccttttctgcaaaaagagttcccctcccaagaggaaatcccctaagcctaaggacaggaggtgatggaaagatggacggatgggcagatagatggatggaaaaaaaatggacagttggaaacagacaaacttggtggatgagcagaaataagcctcattctcgcctgacaatgggacagcctgggggaggggcgggacacaccaaggctcccagttgacccccagcaattggacaagagagtttataaaccagcatcggggttttaggagcattgtaagctgcagagtgcatggggtcttcagtgggaagcatctccttccccatccctgttctctgtcctggggttgcccatcaagctaatcacatgtccacccctggggtccctctggcctctgccactcttcaccaaagtacagttaaactccaggggcaaatgatgtgttgggggtgtggcagacagggattgtgtctcagcagagagggcacagcactcacaaaatagcttcaatagttccagggtcagtagatgtgcccgaagaggaaccccacatcgcaagtggcctaagcctggggtagggtgagcactgctcactcctgcccagaggagtagctgaggggcctaagctctagctctgagcccaccagccattccatccaccacccacctgaaactgttctgttgacccacagcaattggtcctggtgccaggcacagaacagatgctcagaagatacggttgatcctgtctgggtgcagtggctcacgcctgtaaacccagcactttgcgaggctgggatgggaggattgctggaggccaggagttcaagaccagcctgggcaacatagtgagatccccatctctataaaaataaaaattagctgagcatgatggtgtgcgcctgtagttccagctactcgggagactgaggtggaaggatagtctgagccaggagttcgaggctgcagtgagctacgatcatgacactacactccagcctgggagacgcagcaagaccctatttaaaaaaaaaaaatggtatggttaatctgcctttactgattacaaatcaataaatttgtattatcgtaataaatctgtctttattgattacaaggcactttctcatcccccatcacctaagacaactgcataaagaccgcatgagctataaagaccatttccttgccccaggtcacatggaggaaaagagacagagccaggatttaaacccctgcccctggctttcattcctttgctgtgtccctgcagacccgaggcccacctgggtgaagaacaggtgggtggacattggcagtgttcaccaggggaagcatgccaggtgcaaggaaacatgtgagcacctgtccgtgcccaatgggtctctgtttgtctccctgcatcttcacccaaaccagcttctcacacccccacggccaccaccagcactccaggcctctacctgggccctttaatgccccttccccattcctcaagagcccactggggtcccttccctgatggcctgctggcctcctgcctccctccctgacctcagcctcctcggattttcaacagcctggggttgcaggctgagctcagcatctggcaggggcctggaagaaatgacctctagagggcccacactctctgggtgtcatattttggggctattatcacaaaataccttagactgggtaatttataaatgacagaagtgtgttgctcacagttctggaggctgggatgtcccagatcaaggcacctgcagattcagtgcctggtgaggagggctcactctgcatcataggtggtaccttgttgccatgtccttatatggcaaaagaggcaaaggcgcttgctcaagccccttttataaaagggggcactaatcccattcatgaaggtggattcctcatgaattagtcacttcctaaggggcccctcttactactatcacattgggtattaagttccaacatatgaattcaaggggaacaatgacattcagaccatagcaccagacgtctatctggggaagcccccaaatatttgtcttttttttttttttttttttttggaggcaaggtctgcctctgtcattcaggctggagtgcaatggcacaatcacagctcactgcagctttgaactcctgggctcaagtgatcctcctatctcagcctccccagtagctaggaccacagatgtgcactaccacatccgactatttttttattttagtttttttgtagagacagagtctcaccatgttgcccaggctgatctcgaactcctgaccccaagcaatcctcccaccacctcagcctcccaaagtgctgggatcacgagtgtgagccatcatgcccagccagccccctcatatttgatccaggcattaagcctcctggcaagaccagcagctccctgcacctgaggcagggctgagtttcagaagctgcttttcattctcagactatgctgagcctggtactgtgcacacagcacatctgaactttgttcaacatatccctgcaccaacctggcaggacggcctcaggccagggaggaaccggggagatgatgtgggatgagaagagagatcagacagaggctgtctagacacagtttcctggcaaagtcaccaagagccctgcgagcagctgtccacacctcctggcactctctgtatctgtcccgtccctgccagctccccacccgcccagtgcttcaccagctcacccctcagacactgtccaggtgggaaccattcccctcaactccctccagaacaaccagatggcacctgccagcagccctgggagccagaatcccacccacctgacccaagggctctatctgatctcagcctaacccatgaatcaggccctttggagagccaaaggaaaattgggcttccctgccagctgactatgtgacagttcagatgtcccagagcacaggaaagaggcagagacagggtcgtgaggagcccttgcttctccttcaacatctcccataaacagctggagaggggctctcacagggtccatgggaagagaccaaggaggggcatggaggagaggggagggctgagaagaccagggtgaaatggatgaggagaaggaagcagatggcagggaccctcccatctcccacatgggcctccttaggtgctactggccttgtgcaaatttgcacactcacattcacacatttctgtctgcttctctccaatctttcagatacctagcacacaccccagcctctagaatcaggtagtcagtctagcagagtctttagcatttgacttctgggtttaaatcctggctttagcacttcctagcttcacggccctgtttaggcagtttatatgcctccctgagcttcccaaattttggggaggaataaatggcatagcagatggggaacatctagcactgtcctgctatatcatagactgtgaaagatcactgtttttgtactattggccttgctttgtagtaattatcattaacttttttttgagataaggtctcactctgtctcccagcctagtgtgatcatagttcactgccacctcgatctcctgggcttaagtgatcctcccacctcagcctcccaagtagctgggactacaggcacacaccaccacacttggctaatctctctcctttttttttttttttttttttttagagaccgggtctcattatgttgcccaggctggcctcccaaagtgctaggattacaggtgtgagccactgcacacggcctactttgtaataataacaaacaatacagccgctactttttggtagtttcaaaccatgatcccagaattttttgattcatcaaaaggtagaacctatgtcatctaccgttgaatccagactgtgcgattgcttgaccaatagaatatagaagaaacgttatgcgacatccaaggctacatcataaaatgtgacagagcttccactgggttctccttgtcttagagcccagccaccatacgatgaggaagcccaagtagctgaagagaggagaggcccaaacaaaggaaccaagtcccctggaccacagcctagctgagctcccagccaaccagaaagcgccaacttagcaaccactagaggagccatctcagaaatgaattctgcagccccctggtgagctccagctgatgccacgtggagcaggaacgaactgtcccctcaacatcctgcccaaattgtggatgtgtgagcaaaataaatgactgtcatgttttaagctactacatgttgggtggtttgttgcacagccatagacaactggatgacaaacacatatctgacgctttatccgtcattgccatgctaagctgcagatatttttgtaatctacacgtttagaccttttccagcttttagagctcacacttcccttcagtacacctgcaagctccctgaattcattttcatgtaatcctccacttttttccttcagccggttcatgttaggtttctctcatagcccctaaacacagtgctcaaataccaataacctggatcccatcttgcagctctgcaggaagctgtttttgcacaaggttcttccacatttctgggaacccaggagatgtctacttcagctacaatctctcctgctcgtcccctgtcccctcgggagggtctggctcagaacagatttcactgtgggacccaagccaacctgttagccactcctaccccaggacggttgaaacagtctttcagtaacaagacttacttttgaaggatggaattacaatatggaaaaaatacaacttcacaaggtacacgttcagttcatagcagcagccaagactttgaaggaagagttcaagtcgccacaaaaacatagcagagggaatagtacggattttagagccagatagtactggagacttggagactgcagggctgggagggtcacagacagtcctgagttcaaatctccactccaccactcattgcccacgtgaccttgagcaagttatttaacctctctgagcctccatttcctcaaaggcaaattggggataataaacgcagtgtttgtgaggatagataggatgcatattctgctcgtggttgtgccaaccaaggacacattcagagtaaattcaagactcttcttgaagagtcacgagcacagtggcccatggcagtaatcccagcactttgggagggtgaggcgggtggatcacttgaggtcaggagctcaagaccagcctggacaacatgttgaaaccttgtctctactaaaaatacaataaattagcagggcgtaggcatgcctgtagtcccagctactcagaagtttgaggcaggacaatcccttgaacctgagagatggaggttgcagccgctgcagtccagccagcctggatgacagagagagactgtctcaaaatacaaataaaataaaataaaaaaagaatgagactcttcttactgcaaaaactgacctctgcggggtggaaacaaacaaacaaatgagcaaaaaccattgttcttgcctagctgttaaagaatattgcgttttctcataacttgacacgatacagaaacatacaatgaagaatctggtgggtattgaactgtcaattgcaaaataattattcatcactgcaggtccagcctgttctccgggaaggactgtttgaatgtcctgggcctccaagccaagctcccagagcccagaccatctctttggctaatgctggctctatctcctgaagaaaatagtttgatgcaaggaagaactttcattatcttttgccctggagcaccagtaactgtctacaaagagcagagcaagggaagaagggcagtgagaaattaatctttgagtttcctccttggtgattcatccatttagaaatgggtagattcagagaagtgtttcttcatccggtccctctgttcccatgatctcaaaaatgaaaaggcagccaaccctgatcaccacccatcagtcagcctcttttcacaagtgggaggcatgggctgtgctggaccaagtgcaaatgcaagacatgtctctaacaggccttctggaaccaggggaagctggtggcttggatgcacccactgtgaggtagagtgttatactgcagcccccataaccctgcacttctccaagtctatgattatttgactctggaatctggtgtagcacatctgctcagttgctcagtcattacttactgagcacttacaatgtgccaggacaggcagggtataaaggattgagaattgaacaaggtagtcaaggtagtatgatccctgccctcaaagagcttgttttagtatatagggtttctcaactttggcaccattgtgggctgaataattctttgttgtggggctgtcctatgtactataattttttttttttttgagacagagtctcgctctgtcgcccaggctggagtgcagtggcgctatctcagctcactgcaacctctgtctcctgggttcaagtgattctcctgcctcagcctcccgagtagctgagattacaggcaccaaccaccacgcctggctaatttttgtatttttagtagaaacgcggtttcaccgtgttggccagggtcgtctcgaactcctgacctcaggtgatccacccacctcggcctcccaaaatattgggattatgggcatgagccaccacgcccggcccactataaaaactttagcagcatccatggcctctatccactagattccaatatcacaccctttctcccaattatgacaaccaaaaatgtctccaagcattttcaaatttcacccgagggtcaaaattcaccccaccccactcctaccattcacgattgagaacctctattccaatgaaagaagcaggcagcttagtggaaagagtgtgagcttcggagccaggtgggcctgggttctcccttccactttattagctgcgtgatctttggggaatcacttctctctcttacgcatacgtagattatttgaaaattatgggtagcaatcatatttttacaaggttgttgggtgagctaaagatcaaatgtgtaaagaactgtggcaggctgggcacggtggctcacacgtgtaatcccagcactttaggaggccaaggcgggtggatcacctgaggtcaggagttcgagaccagcctggccaacatggtgaaatcctgtctctactaaaaatacaaaaatcagccaggtgtggtgccacacgcctgtaatcccagctacccgggaggctgaggcaggagaatcgcttgaactcaggaggcagaggttgcagtgagctgagatcacgccactgcactccagcctgggtgacagagcgagacaccatctcaaaaaaacaaacaaaaaacaggggcagacactgtcaacaccaaaagtcatcctcttgtcttaattcttcttgctaacagaaccccagttctttcaagggtccctatctcagaagttgggctcagtccctagagggggtgggcatgcaaaccaggtctagttaatgagctatttgagggagggggccctctgggggtagaaggttaataaaaagtttggttattttatttttatgcttttatttttttagagacaggaccttgctctgttgcccaggctagagtacagtgccacaatcatagctcactgcagcctcgaactcctgggctaaaggaaggtggggactagaagatggataagcactccacacttgttagctatctattattgctgttagcactgtcattatcagtattttttttttttttgacggagtctcgctctgtcactcaggctggagtacagtggtgcactctcggctcactgcaacctccgcctcccaggttcaagcaattctcctgcctcagcatcccaagtagctgggagtacaggcgcctgccaccacgcccggctaatttttgtatttttagtagagacagggtttcaccatattggccaggctggtctcaaactcctgaccttgtgatccgcccgcctcggcctcccaaagcgctgggattacaggcgtgagccaccacgcccagccctttttgttttttttttttttttgaaacagggtctcgctctgtcacccaggctggagtgcaatggtgcaatcttggctcactgcaacctccacctcccaggttcaagcaattctcctgcctcagcctctcgagtagctgggagtacaggcacgtgtcaccacgcccagctaatttttgcatttttagtagagatggggtttcaccatgttggccaggctggtcttgaactcctgacttcaggtgatccacccactttggcctcccaaagtgctgggattagagacatgagccaccgcgcctggcccaaatttcattttttttttttagacagagacagtgtcttgctctgtcacccaggctgcaatcagtggcgtgatcatagctcactgcagcctcaaactcctgggctcaagagatcctcctgcctcagcctcctgagtagctgggactacaggtacatgccaccacgtccgactattatttttattttttgtaaagatggggtctcattatgttgcccaggctggcctcaaattcctgggctcaagccatcctcccacctcagcctcccaaagtgctgggattacagatgtgagccaccacacccagcccaaattccaattttctaaagaatctggggctctctgtgttttaagactattagactctccccagtttcaggggatgaatcttgagcagtctgatggagggctggcaaaccattgcctaaacccggcccaccacctgcttttgtatggctcaggagctggaaatggcttttacatttttaagtagttagaaaagatcaaaagtgtaataatatctcctaacacataaaaattaggtgaaattcaaatctcagtctccataaataaacccattcacttatttattatcatctatagctgctttcacactgcaacagcagaacagagtggttgctacagaaactgtgtggccacaagcctgaaatatttattctctggctcttcagaggaaaagatcttaggaaaccagaggttctcaaactcagtgtccatcagaaacccccggagggcacgtttaaacatagactatgggccgggcgcagtggctcacgcctgtaattctaacactttgggaggctgagagtttgagaccagagcattgtttaagccaagagtttgagaccagactggacaacatagcaagaccctgtctctacaaaaaataaaaaaattagctgggtgtgggggtgcacacctctagtcctggctacatgggaggctgaggcaggaggatcgctcgagcccaggagttggaggctgcaatgcgctatgatagtgtcactgtactcctgcctgggcaacagagaccccgattctagtaaataaataaataaaaacatagatcccacccccagagtttctgatttagtaggtctgaactggggtctgagaatttgcagttcttaaaattgcctagacatggcagatgctgctggcctggggatctcactttaagaagcactggtctaaggcaaccttggtaattccattcccttgccagcaactggcttagaaaagggcacgtgatacatttctgaccaatgcgatgaaggagaagtcagctggcagcttctgagaaaatgagaaaatgatcataaaaagggacagatgggctgggcgtggtggctcacatctgtaaccctagtgctttgggaggttgaggcaagaggatcacttgaggcccagagttcgagaccagcctgggcaacagagggagacctcatctctagaaaaaactctgaagttagctgggtatggtagcatgcacctatagtcccagctactcaggaaactgaaggaggatcacttgagcctagaagttcaaggctgcagcgagctatgattgcaccactacactccagtctgggtgacagagcgagaccctgtctcaaaaacaagcggggaacaagtggaagaaggctctcttctctcttgtccatattatcttgagaccatgatggggtgtggctgagggcaagagccagctgctaagaatggaatagtggaaaagtggaaggaaacaaggcccaccattccacaatggagccactgaatcaattaaccacatggccccctgcagagaaacaataacttccattagcatctacaccacttccagttgggttctcagtgatttgaagccaaacacaacctacctggcaaccctacaacttcacccctcaccactgtttggacactaccaaacttaggccatgatgattaaggccaggcatgagctccaccctccctgccaccctatgaggaataaagcagatatggggaaggtgaaagggcatgatttagggatccataaagccccagattggagccttagttctacaactcaataatggtgggctagagctctatgcaccccatactctaggatggggactcatacctgcatggttgactagtgcagtcatgtctgtgcatctgagcagttattttcttctctggaccattattaaccattagagctagcatttgtccccaggtcccgggcactgtgcaagtcttcacctacattatcctactacctcataagatagtttggatgtgtgtcccctccaaacctcatgttgaaatgtgatccccaatgttggaggcggggcttggcgagaggtatttgggtggtgggagcagatccctcatgaatagcttggtgccctccctgagtaatgagtgagttctcactcttttagttcacggcgaggtctgattgttaaaaaagtgtttggcacccttcctgtctctctctcacccctcttctcaccatgtgacacacctgctcccctttcaccctccacagtgaagaaaagcttcctgaggtctcaccagaagcagatgctggcatcatgcttcttgtacagtctgcagaacgtgagctaaacaaacctcttttcttataaattactcaccctcaagtattcctttatggcaacgcaaaacaggctaagacacctcaatggactaatacataacagccccataaggtgagtgccaccatctcccccaccttacagatcaggaaacaggggctctgaaaaactgtggctcactcaaggtcatactgcttgttaagtgcagagataggattccaactcagaggcatctggctcaagaacccatgtgtctgtgtttcaggttgcaatgctgaggttaaacaagaggatgtgtgctaggagccccagcacaccacaggggctgggaaacgttattgcatcgagtttgagtccaacacacggtctcattcctccacccaccactcagcctagaaaaagggtcggaaggttgactccactttcagaagcttgccagctccagccagtcagccagagtgaagctgacaagagcaatgagggaaatacggaaagataaatccagatgtggacaatgagaccgtgtcccctgagaactgtggtggcagcgggactcaaagatccaggcctgctcggtgtggctgcggctcgggttcctgggccacagggctgccttacctgccagtttccatgcctggctgactccccccaccgcccctctggcttccacaccagcccactgatgccaccccagagaactcggctgtttgccttgctcctctagagggcaggtggatgcggtgaaacgggcagcgattccagagccatcacaactcctggctgaaaccaaacatgacagatttaccattgggcaggctgctccatttattatttaacgctcgcaataaatatttgcatgacccagtgctggagggaacgctctgtgataactcactgcattttcctgccaaacaccagcacagtcggattccgaagctgcagcagagaatattttatgctattctaaaaatccaggtgatggccccttgttagaaaaccttttctcatccatttccatagaggaaaaaaggagcagggagaccttagctccgagaagcaactagaggaggaagaagaggaggaggaagatgctgacaggtgacatttacttagcacctactgagtgccaggccctaagctaaggacttcacactcattcattcaacacctctctctagagggtagggttgccagacttaacaagtaaaaatatacgacacccaattcaattttaaatccagtgaaataaggaatgattttttaaatacaagttatgtatctgatgtaatactggaaaattattcaatgtttatctaaggttcaaatttgggtgcaatggcacgcccttatattcccagctacttggaaggctgaggcagggaaatcacttgaacccgggaggcagaagttgcagtgagccatgatcatgccactgcactacagcctgggcgacagagcgagactctgtctcaaaaaaaaaaaaaaaaaaaatagaacaaactgggctacaaagttttgccaggcatggtggctcacgcctgtcaccccagcactttgggaggccaaggtgggcagatcacctgagatcaggagttcgagaccaacctggccaacagggcaaaaacccatctctactaaaaatacaaacattagccaggcctggtggtgcacgtctgtaattccagctactcgggaggctgaggcatcagcatcacttgaacctgggaggcagaggttgcagtgagccaagatcatgccactgcactccagcctgggggatagagtgagactctgtctcaaaaaaaaaaaaaaaaaaaaaaatgtaactgggcatcctgtttgtatctggtaacactccttaaggttggactaactatgcgaagacactgaatttaaaaggcttttcttttcatttattttttaagagacgtatctgtgtaactcaggctgcagtgcaatggctattcacagggatgatcagggctcactgtagcctcaaactcccaggcttaagagatggtcccacctcagcctcccaagcagctgggactacaagtacatgacactgcgtctggtgttcagtggtgcaatcacggctcactgcagccttgaactcctgggctcaagcaatcctcttgcctcagccaccagagtagctagaactatgggtatacagcaccacgcctcgctatttttttttttttttttttttttttttttttttttttagagatggggtctcaatgtgttgcccaggctgatctcaaactcccggtctcaagtgatcctcctacctcagtctcccaaagcactggaattacaggcatgagccaccacgtccagcctcttttttttctttaaggaggcttattttttagtgtgggttagggaagagccatgtgtgaagttgactctggagcagagatgtcaaagatgagaaagagctacccataacaaaaaaacggggaacaggattcctggcaaagaccccacaaagaccctggggctggaaaccatgtggggcattggaggagtcaagggaggtgacacttttggagctgagtaatggagaggaaagtgacaggagcagactgcacagggccttggtcacaatgaaggatttggatgctattctaagttaaagggaaggtatgggaaagcttttcagctggaagtggccaaactggggaccgactctggctgtacggatttctgagcctggagatggcacaaaggacctgacattggcaggaaaagaaaagaggaggaacaagaacacgagaaattgccttaaaagggagttggtcaggtctcgccagaaaagttcacgcaataacaaaccagtcgcccacaacagacatctccacattttcccagagctgtcccccagccaggcggccggagtgaggggatgccgacggtgacaatgctatcaatttccattttgcttttgccaaatacggaaaaggacacttcaaagacttttaaaaataacttccaaacaactcaagggtgaaaaaaaagaaagaggtaaaaaattacagtctgcctgcttgagaatagcgataatgaaaataagtgatagaaataagaacagctgcttttgcacacgttatgtcatctgctccttagcactctatgaagcaggcggaacaggtcatggtatccccatttcatagataaggaaactgagacccagaaacataggatacaacagagaggaaatgatcaggtgggtgagaagctatgtttgtctggccccaaagcctgggttccccaaagccctctgcaggctgatatgagcctaaccccagcccggctcctggctctcagccatctcatcctcccagcccagctatggggagcaagatacctcctaccatgtcccttgcagccttcctccctcacctgcaggggcttcctgcctggaaagcctgttcctttgcccttcttctccagaggattcacgtacctcagcacatgttcgacgacaaagtcacagcactgcagggacacctcccctggagaggaacaggatggtagagtggaaggggcacagctttgccattagaatgcctgagttcaaatcccagctcaatcaccaactggttgggtatccttaagctcttccaaggagtgggggataatccaatccatccccacaggatcctggtggggattaaatgagatgctgtatgtaaaacatcaacacagggccaggtgccatggctcacacctgtaacaccagcacattgggaggtggaggcaggagaatcgcttgaagccaggagtttgagactaacctgggcaacatagccagacccctatctatacaataaaatgtctttttaattagctgggtgtgatagcccatgcctgtaatcccagctacttgggaagctgagacaggaagattgcttaagcccaggagttcaaagctgtagtgagctatgatcatgccactgaactccagccatggtgacagaactagaccccaactctaaaaaaataaaaaacattaaaaaaaaatcagcacagtgcctggcatacagtcagcacctaataagtagtagctgttttttgttttttgtttttttttccatctctgaaaaaaaaaatcagccattttttaaaattagctgagtgtaatggtatatctctgtaatcccagctacttgggaagctgaagcagggggactgcttgaccccaggagtttgaagcttcagcgagctatgattgtgccactgaactccagccatggtgacagaacaagacccaatccctgaaaataaataaatcaattggcacagtgcctggcatatagtcagcacctaataagtagtagctgttagaatacttacaaaaggccaggcgtggtggctcacacctgtaatcccaacactttcagaggccaaggagggtggatggcctgaggtcaggagtttaagaccagcatggccaacacagtgaaaccccatctctgctaaaaatacacacacacgcaaaacaaatcactgggcatggtggcacatgcctgtagttagtctcagcttcttgagaggctgaggcaagaaaatcgcttgaacccaggatgcagagattgcagtgagccaagatagtaccactgcactccagcctgggtgatagagcaagactttgtctcaaaacaaacaaacaaacaaaaacaaaaaaaacactcaaatcatgggattgagtgttcaatcattcaatcaatttttattgaatgcctactacatgctaggtacttagggatataacaggaaataagacatacgtgattctaccttaatgaaacttagaagaaggaatatacttatggtgtagtgaaagaaacatatttattagaaatcaaacataaaaagcataaaaagtgttgaagagtgctctaaaagaacagaggtttctgtgaatcatctactttatttatttatttatttatttattttgagacagagttttgctctgtcacccaggctggagtgcagtggcgtgatctcagctcactgcaacctccacctcccaggttcaagcgattctcctgcctcagcctcccaagtagctgggattacaggcacccgccaccatgcctggcttatttttgtatttttagtagacacggggttttactatgttggccaggctggtcttgaactcctgatgtcaggtgatctgcctgcctcagcctcccaaagtgctgggattacaggcgtgagccactgcacccagcccagaatcatctactttagactgaggcatctgagacgtgctcaaaggacatttcagtggagaaccatgggtgtgaaggagggagtcacacggagactgggaagggacagacctttgtaggacagacggcaacacgtgcaaagcttgtgctgggaggtgaagggagaacaactcgctggaggaagcaaggaagaggagatttagttagagcagacagccaggatcagagcatgcagggtctgatcatttatttccaagttattctgaaatcaaagagaagcaggcttttaagctaagaatgcagcacatcggctagcatagaataagagttcaaaaaaagtgtaagctcccttccctctcctgaaacaaccaaagtaaataaaaatggcccctctgttttgaattatttatttatttgtgctttcaaactgttttcttaaaaaaaaaaaaactacagagtagtgagtgggggcgggggggtaaggggtggaatactcaaaacgtgttcaaaatcaaacgagccagaaactcctcgctggaaattttctctctagatctctgcaggaatcagtggaaccatgagagacagagtcgaaagcagcagagcctggaattatttctctaagcaagacccagacgccaggcaggtagtgaaattgctcctgccccacctccatccttgctgcctatctgagaacagagtctgccaacccctcctgatgagagactgacccctcatagccactgcaggctggaagccataagcttaaaccacttcgataccatgaaagcaaaatgtatggttggcaaaaagcaaaaaaaaaaaaaaaaaaaaactggttactggcgagtgcagaaccacagtctgggtcgatgacaaattatccagcatgaatcttggtgtgacttaggcccctcttagtcctctaaaattcatcacattttgtttattcgttcactacccacttacagtagatgccaagaaatatatataacaagattatagatataaatttaaaattaggactaaagaaagataatctagaataagaggtaaaagcagaacagagcaggatggaaggtagaataaagatatacaggccagaaggccagttactaaactggatttgagaacatggcgctgagttccctggtggccaagtcaaaaagggcagttggagatgttctcatggtccacaaaaagaaacacacttaactttgcagaacaagcactgtcctgccgtgtgacctcagataagtgatttaacctacttagactcagctgcctcattgccaaaaagttagtgaaaattattgaatgtttaggtaaaaagttgtaataaaaaacaagaatgggaaaggattccctatttaaaatggtgttgggaaaactggctagccatatgcagaaaactgaaactgggccccttccttacacctgatacaaaaattaactcaagattgattaaagtcttaaatgttagacctaaaaccataaaaacccaagaagaaaacctaggcaataccattcaggacataggcatgggcaaaggcttcatgactgaaacaccaaaagcaatggcaacaaaagccaaaattgacaaatgggatctaattaaactaaagagcttctgcacagcaaaacaaactatcatcagagtgaacaggcaacttacagaatgggagaaaagttttgcaatctatccatcgggctaatatccagaatccacaaggaacttaaacatatttataagaaaaaaacaaccccatccaaaagtggccggaggatatgaacagacacttctcaaaagaagacatttatgtggccaacaaacatgtgaagaaaagctcatcatcactggtcattagagaaatgcaaatcattgtcagagtgctcagagagggcatgttccctgggtcttggtggatttagaggtcaagggaccatttctggaagctcactgtgtgccagggcagcttatatcagagctccgctctttttctttttcttttttttttttaagacagagtctcactgttgcccaggctggagtgcagtggcaccattttggctcactgcaacctccacctcccgggtccaagagattctcctgcctcagcctcctgagtagctgggactacaggcatgcaccaccaccacacctggctaatttttgtatttttagtagagacggggtttcaccatgtgagcaaggctggtctcgatctcctgacctcaggtgatccacctgccttggcctctgaaggtgctgagattacagtcatgagccactgcgcttggccagagatctgctctggaagaccccccaggctggagggcactgccacaagcagacagtatggcgagggtccctatgaccacctggcaggcagggtggattctggagggaggtggcctgggagcaggctgaggatggggtgagggcatttgagcagcagagtgtctgcgtgaccgggcataactggagggacagtaaatgactcttgtgtgagaggatgagggaggggtgagaggggctgactacccccaggacttgaggtgcagtgagactccttagctttaaccagactcatgggagccatggaggtttgaggcagaggtgtgggctgctgggagagtgaggactcaccatccagagaggaaggtgaagctttcaactctaaatgccgttttattttcgtgtgttttttttttttttgagacagagtttcactcttattgcccaggctggagtgtgatagcacgagctcggctcactgcaacctctgcctcccgggttcaagcgattctcctgcctcaccctcccaagtagctgggattacaggcatgtgccaccatgcgtggctaattttatatttttagtagaaacagggtttctccgtgttggtcaggctggtctggaactcctggcttcaggtgatccgcccgccttggcctcccaaagtgctgggattacaggcatgagccactgtgcccggccccaaatgtgttttacattttcttcctatttgattcatctttgtcgtgcaacataaatatgctacttttccactgataaaaagacaaaatggaatttaaaattggcctggacttctcaaaaaagtcagtgtgatgaaaacatgttctagataaaacagaaatgagactgggcatggtggctcatgcctggaatcccagcaccttgggaggccaaggaaggagaatcacttgaggccaggagtttgtgaccagcctgggcaacatagtgagaccgcagatctactaaaaatttaaaaattagctgggcatggtggtgcatgcccgtatgtctggaggctgaggcaggaggatcgcttgagcccaggatctggaggctgaggcaggaggatcgcttgagcccaggatttggaggctgcagtgagctatgattgtgccactgcactccagtgtgggtgacagagtgagaccctgtctctatttaaaaaaagagagacaagatgatcaggatgagcgcagtggctcacgcctataatcccagcactttgggaggccaaagcaggtggatcacatgaggtcaggagtttgagaccggcccagcctagatggtgaaaccccgtttctactagaaataaaaaaatcagctgggtgtggtggggcacgcctgtgatcccagctactcgggagactgaggctggacaattgcttgaacctgggaggcagaagttgctgtgagcaagatgacaccactgtgctccagcctgggcaacaggaatgagactctgtctcaaacaaaaaaaaaaaaaaaaaaaaaaaagggatgatcaaacacaatgcgtcaacctcccggagctgttgtgagcaagatgacaccactgtgctccagcctgggcaacaggaatgagactctgtctcaaaaaaaaaaaaaaggggatgatcaaacacaatgcatcaacctcccggagccgtataaaccctaaacctaaaccaggaagcaggcaagcctgtgtgtgagtttccactctattgctggtaccactcggctctggcaacctggaaggccaccttcccctgttgttactgtgtaaggaggaaggagcactggtttgcaagtcagaagcctgggttgaagcctctgcttgagttcctgctggctgtgggaatgtggggttacctttcccggctggcctcgtttcctacatgtccaatgcaggggttccagtcacatgcattgggcaccattacatgtccaagctgtgccaggatctagataaatggctgggctcagtccaaggggccttcctatctggcagtgaaaataagaggagataccaagggccctgagcctgagtctggaggaaaagtcatgagcacagggcagtgccagggcctgggagctgccacagaggagcccaccttggtgacagacacctgtaggctcatatgatgccgagtgcccaacacagggaactggacaaaggtttcatgcacgactcttttccctccttggctaccttgaggaccttgattataatagttagcctttttttttttttctttttttgagactcttgctctgtcgcccaggttggaatgcagtggcaaaatcttggctcactgcaatcttcgcctctcaggttcaagtgactctccttcctcagcctccctagtagctgggattacaggcatgcaccactatgctcggctaatttttgtatttttactacagatggggtttcaccatgttggccaggctgatcttgaactgctgacctcaggtgatctgcccgcctgggcctcccaaaatcttgggattacaggtgtaagccactgagcccagccggattataatagccttttcatgcaccaggggctttatactcattatctcatttcattcatatgagttgaagtcagcttatcccccatttcacagatgaggaaaccaaggcccagagaggttaggaatttgtccaaggtcacacagccaggaagtaggattcaaacccagacagccaggctgtaatacctaggctcctctcaggctcatgcccttcccaggggtctgggaagccctgacctgcagcctgtcacctttgtttaccccccagcctccaggatattacgtgtgcaccggcgtgggatcctggaactggcaggaactgtgggttgtgttggtccctgaactcccatcgcctatgtgaaatatggttgcttttgtggcttgggaggccatggccagccccgcgatgccattgactggtgagtgcatgcctgggaccaggctgcaaaatccctcacactctggggtagtcaaggcttatgaggaagtacccaaaactgaagctggggtttggtccagggagatcccagtgtgcagtactactttgcaggcaggcagaggcctcttggataacatggccagtgaagccagatcttggtactagctgtgccttaccctggccatgggctgaaaacgttgccttaaaaaattggccaggagcggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaaataataataatataaagtgaccaggtgtgttgactcatgcctgtaatcccaccactttgggtcgaggcaggaggatcactggagcccaggagtttgaaacgagcctaggcaacagagtgaaaccctgtctctatattaaacacacacacacacacgcgtgcacacacacacacacacacacacatacaaaggcagccagactatgcactaggaactgccctgggaatccctttgtgttctcacaacaatcccatttcacatgaagaaacctaggcacagaaatattcagtaacgtgtccaggtgcggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagccgagatcacaccactgcactccaacctgggtgacagagcaaaactccgtctgaaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatctttccatgacttccactcatttacccccaaggctgttcttaaagacgggcatgacagttatgcccattttacagatggggccctgaggctcacaagggcacgccattcacccatttccacaaagctatagttagttagcagagggcagaattcggccgcctctcccctagcttgtaggctgtgattgacacagaggtttttttgttgtcgttgctgttgtttgttcctttttcttttttttgagacagggtcttgctctgtcatcccggctggagcgcagtggtgcgatgtcagctcactgcaaactctgcctccaagatgcaaatgattctcgtgcctcagcctcccaagtagctagaattacaggtgtgcactaccacgcccagctgttttttgtagagatggggttagtagagatttgtttaatagagacggggtttcaccatggtctctactaaaccctgtctctactaaaaatacaaaaattacccaggcgtggtggcacatgcctgtagtcccagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggacagcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgactaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcagagggcatggtggggccaatggaatcattacccaagacggggattttcagggaaacagcttagataaggccaggcgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcatagttgggaggttgaggtggcagtatcacttgagcccaggagttcaaggctaaagtgagctgattgagccactgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaatcttagataagaggatgctgtgcctccctgggggtcttcagtcacccatagtcctggcaagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttccttagtttcttgagattatcatccgctgagggtggaaggggagtgagcagacacactcaggaggtgtcttgagattatcatccgctgagggtggagctgagggtggaaggggagtgagcagacactcgggaggtgtcttgagattatcatccgctgagggtggaaggggatagagcaggcactcggcaggtgtcttgagattatcatccgctgagggtagagctgagggtggaaggggagtgagcagacactcgggaggtgtcttgagattatcatccgctgagggtggaaggggatagagcacacactcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacagctagggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgctattacaaatacggaacctctgacacttagaatattagatgggggccccactgggtggggatgaaggtgtttttgcgcaacacagttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctagaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcgcctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaacaaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctcctcttctctgtgctcacgttctttcatgcttagtttcctcagactagaagggagagaaatgcacacacatgatccaccagcacgtgtgggattccctctgcccttctggcatctgaaggctgtgattcaaagatcccccctgcaaccttcccacaaatgaaccaactgattctcacaactgaagggagaatggacacctcccattgagggataaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcaattcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaaaccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgatccatactgaagtccactggctctggttgagacccagaagagtcatgcatcagaatagaggtggacaggaaataccctggcctttgtagggactgagcctgcagagacgacctcaattgcagcctgtacggaggacccctgaccatcccccagaagtagactcccatctcttctgcagcaagataacatgctactaggcctcaatgcattgttaaatattttttaaaaagtatctcacatttaacaaaaaaagatcagtcatatggcagcaaaatacaatgtagtatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacactgggaggccgaggtgtgcggatcatgatgtcaggagttctagaccagcttggccaatatggtgaaaccccgcctctactaaaaatacaaaaattatctgggcatggtggcatatgcctgtagtcccagctactcaagaggctgagggataagaatcgtttgaacctgggaggcggaagttgcagtgagccaagatcatgccaccgcactctagcctgggtgacagagtgagactccgtctcaaaaaaaaaaaaaaaaaaaaaaaattggccgaatgtggcggcacacacctgtaatccaagctactcgggaagctgaggcagaattgcttcaaactgggaggcagaggttgcagtgagccaagattgcaccacagcactccagcctgggcgacagagcgagactctatctcaaaattaaaaaaaaaaaaaaaaaggctgggtgctgggtgtggtggctcacgcctctaatcccagcactttgggaggctgaggcgggtggattacctgaggtcagaagttcgagatcagcctggacaacatggtgaaaccccatatctagtaaaaatacaaaaattagctgggcatggtggtgggcacctgtaatcccagctacttgggaggctgaggcaggagaattgcttgaacccaaaaggcagtgagttgagattgtgccattgaactgcagcctgggcaacaagagcaaagccccatctcaggaaaaaaaaaaaaaaaaaaaaaaaaaaaaagagaaaggaaaaccaatgccagtactagcaactcctcttcccctgaaaaaatgacaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaatggacttcagcccttggtgagagtgaggagaggagaaggtgagaaacctgagggcaagaagctgttctttccctttccagggcaaactcatttccacactatggggactccaacagagccataccttcctgtctacggcggttggacctcctggctctctgctgtacatccgtggatccatcatgtccattttgagatgggaagatagtcttcaggaaagacacctaggaaataataatataagaatgacggctgggcacggtggctcatgcgtataatcccagtactttgggaggccgaggcaggtggatcacggggtcaggagttgaagaccagcctggccaagatggtgaaaccccgtctctactaaaaatacaaaaattagccgggcatggcagtgggcgcctgtaatccgagctactcgggaggctgaggcagagaaccgtttgaagctgggaggcggagtttgcagtgagccgagatcacaccactgcactccagcctgagcgacagaatgagactctgtcacacacacacacacacacacacacacacacacacacacaaagaatgacatgaggctggcagggtggctcactcctgtaatcccagtactttgggaggccgaggcaggcggataacctgaggtcgggagtttgagaccagcctcaccaacatggagaaacgctgtctctgctaaaaattcaaaattagccaggcatggtggtgcatgcctgtaatcccagctagtcgcgaggctgaggcaggagaatcacttgaatccagcaggaaaaggttgtggtgagctgagattgtgccattgcactccaacctgggcaacaaaattcaaactctgtctcaaaaaaaaaaaaaaaaaataggccaggtgctgtagctcacgcctgtaatcccagcactttgggaggccgaggcgggtgaatcacaaggtcaagagatggagatcatcctgggcaacatggtgaaaccccgtctctactaaaaatacaaaaattagctgagcatggtggcccacgcctgtagtcccagctactcgggaggctgaggcaggagaactgcttgaacccaggaggcagagggtgcagtgagccaagatcccaccactgcactccagcctggtgacagagtgagactctgtctcaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaacgcaaaacattctcactaatgactgaattcccaccaagatttccatattatcacagtatgcttttaatcttcgaagatattaaatatttgttctcatcatagctaaaatgcaatgcaaatcccatctcagatgtgggtcagatacctatgaatctcctgaggtagtcattgaaatgacttttttcttgagacggagtgtcactcaaccatgctgaagtgcagtggcactaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaacttgttttttcctgatttctgcacataggattaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtgcaaagttgtccaagtccaacagctcaactgaactttcctaaatggaattgttaaaaagtggtaaatttaaaaacttcccctggctcacgtggtgactcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggcggtaaaactgaaacatacttcctcttcccttgaatataaaaaagcattgtggtttagtacttttatcttggatcattgttcagaaggaggttcagcccccacacaaccacatttttattgtcatgaatggcaagacaaaatgtagagctcaacttacgcaaaggataaaaggctcaaaagacaaattatggcacaacttagcagccaaattcttaccaagtatagacttttgacatactgatctcattccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaatctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaatttttttttttttttttgagacagagttccgctccactcagtcgcccaggctggagtgcagtggtgcaatctcggctcactgcaacctccagctcctgggctcaagccattctcctgcctcagcctcccgagcagctgagattacaggtctctgccaccatgcccgactaatttttgtatttttagtagagatgaggtttcaccatgttggccagtctggccttgaactcctgacaggcgatctgcctgcctcggcctcccaaagtgctgggattacaggtgtgagccaccgtgcccggccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagcgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctggcaatacaggtgtgagccactgcacctggccagtagttatcttttctttagttatttacttgttttttaaattgatgtataatattggatgcatttattatatatcacatggtaaaagaatccctctaaataatacttctctcttggattatatgaatctttgtcatttaaagctcagcataagtaaaaaaaaaaaaaatacaatgaagagattacttcattcacaaataagtatcgaattttagttcttaaaaagtaacaaggtgggctgggcgtggtggctcacgcctgcaatcccagcactttgggaagccgaggtgggtggaccgcgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaattaccaaggtggagatcatgaaaatggcatgaatagcgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccgtacaacaatggtaatgatttcagaaacatggtgttgagcagaataaagcagacacaaaagagtacctatggcatggcatgcatctgtatacgcgaaattccagaataagcaagctaacctatgataagaaagagactggctgggaagagtgagagttcactttctggggtgacataatagtgtagatcttggctgggcacggtggttcatgcctgtaatcccaacactttgggaggccgaggcaggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattgccccattgcactccagcctcagcaacaagggagaaactgtctcaaaaaaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcagatcacgaggtcaagacatggagactatcctggcgaacatggtgaaacccagtctctactaaaaatacaaaaagtagccaggcgtggtggtctactaaaaatacaaacattagccaggcgtggtaatctgagctactcaggaggctgaggcaggacaattgcttgaaccccggaagcggaggttgcagtgagccgagatcttgccactgcactccagcctgggcaacagagtgagactctgtctaaaaaacaaacaaacaaaaaaaagtcatcaaaccagatgacacaaatcaaatgacatttcactttgttttggtccgttttgtctgttggagacaagagtgcaacagcgccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcagccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggcgccctgaggcagccaggacagaggtggaggtggcttagggcaggggggagggaaggggacggggaccgggccggatctgagttggggagggggaggggagggggaggggagggggaggggaaggggggaagtaagggaagggaaaggaggagaagggggctgttggggaggaggaggaggagaagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattagagggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccatctcagtcccccacgctcctcccaaggccaggtcctctctggaaccttcacaaacctgacttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttgtacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaactgagtgatgatgtccttatctatgtcatcttactgcccgtgtgtgtggactttaaattctgaacccaaatgagggggagaaaaccaagctgactttcatgactgagctctcagggacgtccaaggaatctgtgcatttcaagaaacaaagttcatcagcttctctcctaaggtatttgcccacaatacccagagggcttggccgcatcatgtgtgatgggtggggagctccaagcaggcgggcaggacccaggggcctggtgaccaggacagacccccactgtccatcacctttcctggccctgtcctcagctaaacttcccacaggccttctgcccgatcacacagagtgtgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaaacaagcaaaacaaaaacaaaacaggggctgggggtggtggctcacgcctgtaatcccagcactttgggaggccgaggtgggcagatcacaaggtcaggagttccagaccagcctggccaatatggtgaaaccctgtctctaataaaatacaaaaattagccgggtgtggtggtgggcacctgtagtcccacctacttgggaggctgaggcaggagaacagtttgaacccgggaggcagagtctgcagtgagccgagattacaccactgcactccagcctagacgacagagcgagactctgtctcaaaaacagcaacaactacaaacaaacaaaaaacaggattaacaaaactatggaattcaattctatttatatgctgcagccatgttccagccctagatttggctgggcatggtggctcacgcctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaatcccagctactcaggaggctgaggcaggacaatcccttgaacccgggaggcggaggttgcagtgagccgagatcgtaccattgcactccagcctgggtgacagaatggaatgagactctgtctcaaaaaaaaaaaaaaaaaaaaagaagccctagatttcggttgtgttggttgtaaaaggagagacccagtaagtgggggttgtgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccacgtggtgtgaccacatggagccacagacacccagcaaggacacgcagcccgcacacccccggtactccagacacagtgacctgcaccagggctcgaggtttctctagggaacccacctcttagaatcatccagaaacaagtcactcttcacctgtccagcaaaggcctgctgagaggtgcacagtgtctggagtccaagctgcgccaaggcggcaggacccccagcccagcccaggacccccagtagagccctcacctcagcgtggaggcctgagaacgtgaggaaggagctgtccagcacggacgagtccaggcagctgtcgatgtccagcacctactgcccggcaggtgtggggctcaggctcccagccacctgcaggacgacggcagtggtcagcgggcggcagctcagacctgctcaggacagggatgagaagccacctcctcagcagacaggacagagcccggtgccatctaacagaatgtcctagaatgctggatatatgggacatctgcaccgtccgtgatggcagcccctcgcgacatgtgccactgaacacttgacagcagactggtgcagctaaggaacagagttttgaatttcattttttttttttttttaagatggagtctcgctctgtcacccaggcaggagtgcactggcgcaatctcagctcactgcaacctccacctcccgcgttcaggcgattgtcctggctcagcctcctgagtagctgggattacaggtgcctgccacgatgcccagctaattttttgtatttttagtagagacggggtttcactgtgttggccaggctggtcttggaactcctgacctcaagtgatctgcccgcctccgcctcccaaagtgctgggattacaggtgtgagccaccacgcccggccatcgttccattttaattaactttaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcccaagcttttctttgtgggattttttttttcttttttttggagatggagtcttgctccattgcccaggatggagtgcagtggcgcaatctcggctcactgcaagctccgcctcctgggttcatgccattctcctgcctcagcctctcgagtagctgggactacaggcgcccgccaccatgcccagctaagtttttgtatttgtagtagagacagggtttcattgtgttggccaggctggtctcgaactcctgacctcaactgatctgcccgcctcggcctcccaaagtgttgggattacaggcgtgagccaccgtgcctggccctttttaatgttttatatagatggggtcttgctatgttgcccaggctggtctcaaactcctggactcagatccgcccacctcggcctcctgaagtgttgggattacaggcgtgagccaccacacccggcccggccactgggaggtttctaagggactaactcggcctcttcacttgctatagatgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggccctgggcatggtgccgaggcccaggctccattcccagtactcccgggtccccagccccagcccaccttgctccgggacatccggaagagaaagaggatggccaggtagacgggatagacaaccacgctggacaccaggccaacagcgactgtgtcgacgctcagcgggctcagcctggacacatgccccgtgctgtgtggaggagaggaggccacacaggtgaggctgaggggcaggaagggctgggcaggaagaggctgtcccgacccctacggcacccacctgtaggcagagtcaccaacagccccgtaccacacggcgttggcgcccaggaagaggcagatgaggagaacgcagcaggtggccctctggatgcgagtgaaacagctacgaggtggccggtcccatatggagagccagatgtgcttgtcaaagaagccacgctgcagctcagccaccagcaggcgccggaagcgcaacagggctgcgtgacctagaaggcagggagggccgcactgcaggaggccacggggcaggaccaccctgcccaacctcccacggagtgggaacatggaacgaggccttactcgcagccagcacctccttctccaccaggcccccgttggcctccgtctccaccgaaagccagtcattgaccaggaagaaggtgctgcgtgccgtctgcaggtccctgacgatgatgtgctgcaggaaccaggcagggctgagccctgcagaggcgcgggagggaggtcaggctcgcagggcgccccaatgcgggggcagaggggcagagcttggcagggtccgcacagacctttgttgtcgtgccacactcggatcttccacacgctacccaggctgtgcggggtggcgatccggaagatgtccagactgttgcggtggaaggctctgtcgccgtccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacggctctgccatacacgaggagctgcggttactgcaatttgtccaataaacagcaggacctcaaggacatgattaagttacacggaaagaactgtaacttgtgacatgcaaacatggctgcacacgcctcagtccacaccacaaccagtgacccgcgctgcacacctgtccacgcctcagtcacgccacaaccagtgacccgcaccacacacccgtccctcagttcatgcacagactgcgaagcgtgaagctgtgtcacctcctctcccagtgacagacccaggtgacagtattttttttctttttttttttgagatggagtcttgctgtgtcacccaggctggagtgcagtggcgcaatctcagctcactgcaagctccgcctcccgggctcacgccattctcctgcctcagtctcccgaggagctgggactacaggtgcctgccaccacgccgggctaatttttttgtattttttagtagagacagggtttcaccgttagccaggatggtctcggtctcctgaccccgtgatttgcctgcctcggcctcccaaagtgctcggattacaggtgtgagccaccacgcccggccgacagtttttaaaagtaggtaatcaaaagaactgggaaatgaagatgaaagcaacacggaaataaaaaatgggaacacagccaggtgtggtggctcacacctgtcatcccagcactctggcaggccgaggcaggcggatcacctgaggtcaggagttcgcctggctgacatggtgaaaaattaactgggtgtggtggcgtgcacctgtactcccagctactcaggagaatcgcttaaggggaatcgcttaaacccaggagctggaagttgctgtgagccaagatcacgccattgcactccagcctgggcaacagagtgagactccgtctccaaaaaaagaaaaacgaaaacaaaaagggaatgccagaagggcaattccaataaaggaaaatggaggtattgaagaaacagccacggggagggtgctggcacctccgtctgagagacgagctatgcagtcaggatcgcgggtggatgcatggtctcccacagtggtagcgatgctcatgtcacttgtggggccacgctactgtgcagaacgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgcctgcgacgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcagccccggctggcatccaactggtccagcttgtgcaggatggcggccatgaccatgtaggtcaccaggcacacagcacatgtcagcatgacgatgtagtttacatccgctgtcggctcctgtgaagacacagccgccgggcccaggaggtcacgtgcaagctgtgccttctcaggatagagccgagcccacccaggccctcctcgactctgcagaggctcccaggagcacagggtcactcacaggaaacacaaagcgtacatggcttgggggcatgaagaggctggcgccgaaggcggtgaggtggcgggtgaggcagacggcctggcggggcgaggtctcctccaggggcagcagcccctctgtccgccacaccacatcctcctcgctgaagtactggcacagggacgtgtacaagcccacggacacctccagcgccgaccagcggaagtggctggagaggttcagacggtaactccccactgggtctctggtcctgggaagggaaggggcagtggacgtgagcccaggctccgccaggttggatgtcggagtcccagagcccatacccggtccagtcccctcgctgcctgccgtccccacggggcccgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgcgctcattgggccggggctccgagtgcaggtagactgccaggtagggctcgggttcctcagacaggtagcggcctggggcagaacgcgcaggtcacacgcctgccgggaagctcaaccacccgggggacacccacgatggccctcctgagcccaccctctgccacgggcctgaaaggccataggagcctctgcaccagagctggcacctgcttctccgtggcccccagctcctctccggccaggcccccaacagcccatgaaacagcaaatttcaccagagacacccatggaagccctacgagaaacgccttccccccaagaacaaggccagggggccgcgtgtgccccacccgctgcacacaccgtccagcagcgtatagttgagctgcagatgcagcacggccacagggctgctgctgtccagggtgaccacagcaccgacggaggcctggggctggaccacaacggagttggcggagctgcggtggccccgggcagcccagtccgagttgttgggcaccttcacggtgatggcgcgctctgaggccagccgctcgatggggatctgggcgccggcctgtgtctggaacgccatcgaggccaccttggtggagacggtgtagttgctgatatagccaaagagaaagggattggagtccaccagaaagacgagctgcaccacgtcactgaggttggcgggggccctgctgaaagcctaggggatggagaggtggcagccaggccctggggcgccgccatagcacagcaggctccgcgggtccgagcgcttgccctgggccatgatctcctcgcccgccagcgtcacgggctcctcgttgagcacgcgggagcgcgtgaggatgcgcatgagggcagaggtcaggttgtaggcctgggacgccaccatccgcaatggtgactcggctcccagctctgagcgctgcggtgcccgcacgtctgagctggccaggtggatgaggtctcctgcagacaggcgtgaggtcagtgcagagacagggaggcagagggagggtgggggcaggcaaaaagggggagccggagggtgggggctgggagaaagggggaacctgagggggcagagagcgaggtgcaggcagaaggaagagggaagctggagagagagtggtggagggggagggggaaggggatggggatgaggacgaagatgagggggatgatggggagagggaggaaaaaggaaggaaaagggtagagaaaagagaaaggggagaagaagaggagcagggtgaaagggaggggaaggggataagggggataagggaggggaagggggataagggaggggaaggaggataagggggataagaaagatgaggggaatggacaaaaggacggggaggatcgggggggaaatggagaaaaggggagagagatggagaaaagggatggtaatagggaagggggagggggaggagaatgggaattgggggagggggataaggatgggaattgggggagggggatgaggatgggaattgggggagcgggatgaggatgggaattgggggagcgggatgaggatgggaattgggggagggggatgaggatgggaattggggggaggggagggggacgaagatgggatggggcaaaggcgaggcggttgtggggaggagggaggcagaggaaagggcggcatggggcggacgggccacgtggggcgggcgggtggcgtggggcacgggccgcggcacctgtgatgttgaggatgctgtctccgatggcggtgggcgtcacggtgcccgcggtggtctctgcctgcaggatgcgcatcatggcctccagcttgtgcagcgtctgcttcaggcacgagcggcatacgagctccctgctgggcccctgtgtggagccagcagtgtccagccccgctcctggccccactccttgcacacgccctcctctctacacgggtcctcacctggctcccacccccagccctgcagctggagagcccacttgactggacccccacagcctcctcactaagcattttttgtggctctgcatgacccagggcctccacctggggaacacgtgatgcagcccaccgaccacacaaggcacctcttcacatgagagaaggaggagggcagaagggagagaggagagggaagtggagaaaaggggggagaggagagggaaggagagagaagggggagaggagaggggaggggagagaaggggggagaggagggagggggaggaggggaggaaggaggaggggaggggtgaggggatggaggggctgggggaggagtggaggggctcagcgggatgaggtgaggggaaggtctaggggaggggaggaggggaagggctaggggaggggaggggctgggggaggaggcaggggctaggggaggggggagggactaggggagggaagggggaggggaggggttaggggagggaaggggaggggaggggctaggggagggaagggggaggggaggggagagtggagggcacagagcagcatcttcttagtccctccccacatctgggcccctctttacaccctgggtcccccgagaggcaccctgcgttcacacaggacagcagaatggctgaggctactgaagcaggtcagagaccgaggaacgccatggcaggaaggagcccaggctggaggctcagctcctcggccaagctgcccgtctgccctggggggctgaacccagtaccctggcaggcatgcggggcggggagagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcagggggcacagcaagctgtcagcagggcaggaggccggcaggaggccagcagatgcccacgactcccggggtgcagttacgtgctagatgctgtgtgatgtgggcactgacccgcaacactgagctgtttcttcatgggcaaaacagggtaagcacatgggccctcctgggcgggggctgcattgtggaaagcagacgccggagagggcccggtgggtgtggctgctgggagcggaacgtcggggtgctgcttcagggtcactgggatttatctctggggcccgggatgagccctccgcaaagctccaggcaggggaacaggtcttggtccccagcacgcatgcagcagatgtgaggtcccctcccaggctgcactcacctcgttcagcacagtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctacgagcagaggggggtggtgagtaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgcccttgtagacacagaactcctcgcagtggccctggcgacagcgctgcagcagcagggcgtacaccagcggggcgccagcatcctccgcgtcatgccagcctgagggacggtccccacggcatcacgggagggctccgtgacctcacagagtcgggggatcccgctgctccccctacgcaggcctgcactcacccatgcattcgaagtgcaccttggtggtgagagcgtgcacagcgcccagtgggaagaggcggcaagagccccccagcggcgggcggttgggggacagggggatggaggcgcagccctcctccttgccagagcggcccagcaccgtcagcgtgaaggtgtatccctcgccgtcccgcagcacgccccgccgcagcaccagtcacatgcctgcgctgcccgtggatgtggtggtctcatccagcaccagcgtcttgttgctgaacgtacgtgcagcccaccgctgcaggcagaagggatggtgagggggcgcaaccctctgccctgtcagccccacttctgcctgcaggccccgtcccctcggccatgggacccatccccaacccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactgcggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgcgttctggtgtactggagccagctggaccctggcaggaggcaggcaatgctcactgagggcccctggggggatgcgtgtgggaacagacgtatgtgtgggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggccagctgaggaaagcagggactggggaacagacacccactctggggtaccagcaggccccagtcagggaggcgcacacgctcacagagggcagggaggcgcacacgctcacaggcacctgctgcgtccggttctcgaaggcattagatgccagcaaggtcaggacgtactcacctgtggggacaggcccaagtggggcagccgcggcacccccacctgctccccacccgctcggcagaagccccccgcctgaggagcccggggtgaacggctgcacctgcggcccagccttaagggtcccaggctcccaagccacgtgcgggacggagcacaggtgcagcagcactgagggctgcctggtgaggacggcaccgcctccaagtgcagctgcactcggggcagcagagcagcaagagccaggccgcggtggggggcagttcagggggcccagcttccctgtccactcctcccacgcctggcccctccctcaccccagtaggggcctaagccatcagcccaggtgaggtcacagtgagggctgttggggaggaagcggggcagcttgactgggggactgggggggccccgtgctcagagcctgaaaggcagtggccccctcaccccctcatccctcacctggggcagcgtaggtgtgggtgacattgtgctccaccagcacctgggccaccgaggggtctggaaccgggaaggactcgttgtacggaggctggaactggtggagggcctgctccccatccccaaaggtccacctgccggggcggtgggaggcagtgagtgaaccgggacaggggtgcgcagtggcggggcacaggtgcgcggtggcggggcagggggtgcttgggacccagccgaggctccactctgcagtcacgccccgggcctccattcagggcccacccggctgtgctgaggcctctcccggctcccgtgcagcctcagggctcctgtgcacccagtacctcccaacagacagggaaaccgaggctcagaaaagcaaccccctgatgtggggtccctcggctgaggctggagccgggacaagagcctggtgcccggacaagagcctggtgcccaccccaaaccggcccctgagtcactcacaggaaggccacctccacggccgagtccaccagcacgcccgccgtcagtgccagcgtggcattgggggacagcacggctggcactgtagagacccgcaggccctgcatcctgttcatccgctccacggtgatgttgtagttcacggtgacgttgctcacgtggttggaggccgtcagctgcagggacaggcatcagtgggcccaggtggcaggtgagaggcctgccctgcttggcgtccctccctccactcaccacagccatggcagcgtcctcgggcagcatgaagcagagcagaaggcagaggtgaaggtggagcccgcccccgccccgccccatcccctcccctccccactcccgcccacctactgagagcttgaagaccgccgcgctctgataaatgacattgaagaccacgttctggaaggtcagggactgcttgtcgttgatggtccaccggaagaccatgtccgagccggcctccaccacggggctgtacctctgcggggggactggtgtcagcctgggctctgtggaggactctgcccttagcctgtcgcctcctggacacacctcccgtcgggctggagagtcccacgcggggcacagaggagaggaggtgcccggggctctgcatgccatgagagccaagcccgggctgggacactgactgtccggctctccagccagccatgtagtactactaatgcctcaacctctctgtgcctcagtttccccatctgtaaagcaaacctagtaccagctacaaagagtccacctctctctgagtcttctcagaccctcccggggctcctgccccagctcctcagccagagagctcggagcagtgaggggaggcacacgggcctcacagggacagcacctacactggcttacagaacccaggacaggctgcacaggtcacgccatttctgatggcccctcccaaggcccctggtgaaggggcaggtacccgcaagatggaacagccctgtcccccatgtacccagcatggtggcactgcgggcagcccgcagtttcccatcaggggttcggactccacctcaaaagccacttgctttagccaggcgagaacacagcagagggcgtgagagactcacggggactcgtgtgaggtcagggagcggagttttaaattcatttcgtgaaatgagacggtggaatgagttagcggagccgctgtcagagccgtgactttccaggaatttaaagcccaccaggtagcctgaggagccagccagcaggacctgcccggggccgacgtccccagtaactgggctgctgccctcactgggaagccaggcctcaagccctgtgtgagcaccctgtctgcaggcacctgcctgggggctggtggtggagcctcggccatactcaccactgggactccctgcagtacacgggcctcggggctgggcgtggcgcggaggccacagatgggctcctccgccgtcacccgcaggctgaggttggcccggctggcgctgttttccaccacaacgtccatcacgtgctccccctcaccgagccacggcagtgctaccactgagaacagggtatcattggtctcccaggggcagccgggcacgaaggtggccaccagggcagggcaggcattctcaaagcgggcgctgacactgcccccaggccagcgagccgtggccgtggcgctggcaccagagtccacctggagcaccgaggctgagccgttggtgggcacgtagaggcggccgtcgcggggggcagggtagatgacccgcagcccagccactggggagaccacgtcaaagctgcaggacaggttgtgcctggacacgccattgcccacctctgcccggacctcatagcgcccaggcagccgcagcccagggttgggcctcaggcccagcagcacggtgagctgttccgtggctgcaagcagccgcagggcacaggcagggcaggcccaagtgccctccagctgggctggcaagtggggcagccatgacgaggcgttggcggagaggtacggggcctggggaccagggtggccgggagccggcgagcagtgcaggagggcgccagggccagcgtcgtgctgcaagccaacgaggtcaccagggagcatgaggacatcctggctgtggagggtgacctgtggagagggaggcagggctgcatcacgtcctcacggtcatggcccgtggacccctgcacgacggatgagggtggacacgcagggctccccgcttcgtcagccacacctcagggagcctccccacagtgctcgtgacaaggacaggcaggacagttgcagacagggggacacacggggagaggacacaggccaagacctggcagacaggaaggagcggctgtgctgggagagaggaagaggaggcacagctcgtgccaagggcccaggcgagagcttctcccactgggagaggggcaagggcactgcagaggtcggaggttggaggtcggaggtcggaggtcagaggtggcaaggacgtgggaggggcctgcaggctgggtgtgcctgctgcgcagacccagaccctgggcagcagacaggaaggtggcctgaggagatgcagggaacagacccaggtcagggccacacaccgagtactgcgcggggggccccgcgggaacggagaagaggaactctctccatagcgcatagggggccccgagtagccctggccctgacgtgcagccattggcgcaggcctgggggtggcaggaggcgtccagcggcaagcagatgttggctccagggcaccagcgtccccctggcatgcacgcggggaccagctgggtcctgttgtccggggacctgctctcaggctcgctgccgttctccggggtccctgcgaggaggggagggtgttggggccctcattcgcccacgggccaccgtcagagatgcccaactgcctgcaccagcgagcctggccttgctgtgaggacaggtctccccgcccgggcagcactcccagcccagtgctgcgtccctgtctccggccagctgactgacccaggccggtccccaggcaggccccacccgatccacccccaggacacctggaatgagctggtgtctctggaacccctgctctgtccacctaagactgggaaccactctgatggccacaggaccagcagacgtgagagctcagagaggccaccccgagtcctgcggcgcccaccaccccagagtcccacctgctgtgctgaggagccggtacacctgcagccgcagctgggcgggccgccggagctcctgggtcccaaattcggccgtggtgaggaaggcttcacggctcagacgcaggcccgggaataccatgacctggtgggcagggggccgcctcagctccacagaccccatcccagcctgaagcccagactccccccacccgaacttcgcaggaagaggggagggaaggagagcgagccatcggacccccacaggcctggctcctgtcgctcgagaggaagactccgatggaaactgtccatggggggcaggacccctgacctgcctttcaggaataactcacccacactcagagaaaaggcctgggggtaatgtgagtaaacgctttcctctctgcactctggattttcccaaccatcttcactgggcacaagcaacattaaggcccccaagttttttggcgagacccacagtgggcagggcaggcgaggcctccaggggcaggcaggagggcaggttatagaacgtggggggccgactacctccacgggctcgtgcggggctgagaggccgtcctgccgtgccagaggcatcaggggtccctacaggtccccactgggcgctcccacgaggaggttctcggcatcctgcactgggcctggggtggcaagtgcacagtgaggcgccgggccagggcccaggacaccaggacgaacagactggggaccgagccgcccgagaacccccccaccagcccctcctcctcagcccaggctccaccgcgggcgctcggcaggcccctaaccacagccagcgtctcaggcccctgcctggcccctcgcacacctccaggccgcagctcgcagacgtagctgtgcggcgctgagcacaggtcggtgttacaccacccggtgggcccgagccggacgcagtgctcggctgtggctgggtgtggctccccgggcagccagttctggcagctctccaggctgaaggcctcgccctgcggcgctgggcccacctccaccccctgcacagtcgagaagccgatccacatgtctaggctcctgggggcgggtgtgggatggcagggggctcagggcactcctccatcctcccaccctcacagcagcccgctgggagccccgtcactgtccccctttccagatggggaaactgaggctcagagcccggagagcagggcccaccagcccaggctcacagcagcacccacccacggggcctgtgggcaccggcagggatccccgtgcaggccacctcccgtatggcgtgcccaggagtgtccggaggctgcccccagctcgcgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtggggcaggcacctggtgacccgggagaccaggaagcgctgcacggcgggactgtccaccattgccagggtggccccggcccaggcccgacactgctcctgcgcctgcagccaggccgccttctccaccaccaggcggtagcagtgcccattgccagagaagatctccgtgtccgaggggcagagcgggtgcaccgctggagaccagtgggaacgagggtgtcaacggtcagtgtgggcccaagacgggggtaccaggctctgccccatctggatggccctggggaggaaggggagtgggcagcagacactcacctcgggccggctcctcgcccagggccacgatgctgtaggcggcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggtccccagggccagcacggccgtcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccagggtggcccctggggaggcagggaagacgtgctggaggagggtggggcccctacaggtgggggcaggaggcggcggggggccggagcagagggacaggcaggcgaaggaggcactggagggctgggctgacccacacaggcaccagccctgctcggagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacccccccatccgcccgccgcactcacaggctcccatgctgttcccttggcccggaggccccccccagagaggccttcctgagccctgcccagtgtctgcagggcccaggtcccacctggctgggaaggacagagctgccccacccaccggcactcaccacagccactgtccagcaaggggatgccaagcagaggctggccagccagggagccaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacggaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacattgccagcatccccaagctatggcctcccacccttgagctccccactcccagaggtcaggaggggcctttctgatggaagacccaaatgaacactcatctggggaaaccaagccgggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtctacagcccccacacagactcgaggggcccccatctcctgttctgaacccaacagggtggtcccactgtgggaccacaaccaggtatgactgtgtgagaagcaggctcactaccaggctaccagggagcacagcggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaggaaggatcgcttgagccagggaggtcgaggctgcagtgagctatgattgtgccactgcagtccagcctgggcgacagagcaagacccggtctcgaaagaaaagaaagagaaagcaagaaaagaaagatggctgggcacggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaataataataatataaagtgaccaggtgtgttgactcatgcctgtaatcccaccactttgggtcgaggcaggagaatcactggagcccaggagtttgaaacgagcctaggcaacagagtgagaccctgtctctatattaaacacacacacacacgcgcgtgcacacacacacacacacacatacaaaggcagccagactatgcactaggaactgccctgggaatccctttgtgttctcacaacaatcccatttcacatgaagaaacctaggcacagaaatattcagtaacgtgtccaggtgtggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagccgagatcacaccactgcactccaacctgggtgacagagcaaaactccgtctgaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatctttccatgacttccactcatttacccccaaggctgttcttaaagacgggcatgacagttatgcccattttacagatggggccctgaggctcacaagggcacaccattcacccatttccacaaagctatagttagttagcagagggcagaattcggccgcctctcccctagcttgaaggctgtgattgacacagaggtttttttgttgtcgttgctgttgtttgttcctttttcttttttttgagacagggtcttgttctgtcatcccggctggagcgcagtggtgcgatgtcagctcactgcaaactctgcctccaagatgcaaatgattctcgtgcctcagcctcccaagtagctagaattacaggtgtgcactaccacgcccagctgatttttgtagagatggggttagtagagatttgtttaatagagacggggtttcaccatggtctctactaaaccctgtctctactaaaaatacaaaaattacccaggcgtggtggcacatgcctgtagtcgcagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaatcttttgtgtgtttttattgtctcgagacagagtcttgctctgttgctcaggctggactgcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgaggtaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcaagacccagagagggaggcaggcaggcaggcagggaccaagcttgggcacagccaggaaggcagagggcatggtggggccaatggaatcattacccaagacggggattttcagggaaacagcttagataaggccaggtgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcagacttgggaggttgaggtggcagtatcacttgagcccaggagttcaaggctaaagtgagctgattgagccactgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaaatcttagataagaggatgctgtgcctccctgggggtcttcagtcacccatagtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttccttagtttcttgagattatcatccgctgagggtggaaggggagtgagcagacacactcaggaggtgtcttgagattatcatccgctgagggtggagctgagggtggaaggggagtgagcagacactcgggaggtgtcttgagattatcatccgctgagggtggaaggggatagagcaggcactcggcaggtgtcttgagattatcatccgctgagggtagagctgagggtggaaggggagtgagcagacactcgggaggtgtcttgagattatcatccgctgagggtggaaggggatagagcacacactcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacagctagggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgctattacaaatacggaacctctgacacttagaatattagatgggggccccactgggtggggatgaaggtgtttttgcgcaacacagttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctagaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcgcctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaacaaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcacgtgtgggattccctctgcccttctggcatctgaaggctgattcaaagatcccccctgcaaccttcccacaaatgaaccaactgattctcacaaccgaaggaagaatggacacctcccattgagggacaaaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacagggacgaaatcacttcaaagagaaagttaatgaacttgtttctgaccacagggcatccttcagcacatgctgtctggagtggcctcaaacaaggtgtgtgtggtgaggtgctgacaatgcaatgggagcagggtcctgtccccacgctaaagaagctcacagtttaatgcaaatgagaagccagtgaggacagcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgatccatactgaagtccactggctctggttgagacccagaagagtcatgcatcagaatagaggtggacaggaaataccctggcctttgtagggactgagcctgcagagacgacctcaattgcagcctgtacggaggacccctgaccatcccccagaagtagactcccatctcttctgcagcaagataacatgctactaggcctcaatgcattgttaaatattttttaaaaagtatctcacatttaacaaaaaaagatcagtcatatggcagcaaaatacaatgtagtatgaccaaaacatgaaagactgtgaaaatgaatttggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgagttgtgcggatcatgatgtcaggagttctagaccagcttggccaatatggtgaaaccctgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaattggccgaatgtggtggcacacacctgtaatccaagctactcgggaagccaaggcagaattgcttcaaactgggaggcagaggttgcagtgagccaagattgcaccatagcactccagcctgggcgacagagcgagactctatctcaaaattaaaaaaaaaaaaaaaaagcctgggtgtggtggctcacacctctaatcccagcactttgggaggctgaggcgggtggattacctgaggtcagaagttcgagaccagtctggacaacatggtgaaaccccatctctagtaaaaatacaaaaattagctgggcgtggtggtgggcacctgtaatcccagctacttgggaggctgaggcaggagaattgcttgaacccaaaaggcagtgagctgagattgtgccattgcactacggcctgggcaacaagagcaaagctccatttcaggaaaaaaaaaaaaaaagagagagagaaaggaaaaccaatgccagtactagcaactcctcttcccctgaaaaaatgacaaacaagaatgtaggaagggaaaggaattatacagcttaaactaatgaagcagaaaggacaagctcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaacggacctcagcccttggtgagagtgaggagaggagaaggtgagaaacctgagggcaagaagctgttctttccctttccagggcaaactcatttccacactatggggactccaacagagccataccttcctgtctacggcagttggacctcctggctctctgctgtacatccgtggatccatcatgtccattttgagacgggaagatagtcttcaggaaagacacctaggaaataataatataagaatgacggctgggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccgagctactcgggaggctgaggcagagaaccgtttgaagctgggaggtggaggttgcagtgagccgagatcacaccactgcactccagcctgagtgacagaatgagactctgtcacacacacacacacacacacacacacacacaacacaacacacaagaatgacatgaggctggcatggtggctcactcctgtaatcccagcactttgggaggccgaggcaggcggataacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaggttgtgttgagctgagattgtgccattgcactccaacatgggcaacaaaattcaaactctgtctcaaaaaaaaaaaaaaaaaaaatataggccaggtgcggtagctcacgcctgtaatcccagcactttgggaggccgaggcgggtgaatcacaaggtcaagagatggagatcatcctgggcaacatggtgaaaccccgtctctactaaaaatacaaaaattagctgagcatggtggcccacgcctgtagtcccagctactcgggaggctgaggcaggagaactgcttgaacccaggaggcagagggtgcagtgagccaagatcccaccactgcactccagcctggtgacagagtgagactctgtctcaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaacgcaaaacattctcactaatgactgaattcccaccaagatttccatattatcacagtatgcttttaatcttcgaagatattaaatatttgttctcatcatagctaaaatgcaatgcaaatcccatctcagatgtgggtcagatacctatgaatctcctgaggtagtcattgaaatgacttttttcttgagacggagtgtcactcaaccatgctgaagtgcagtggcactaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaacttgttttttcctgatttctgcacataggattaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtgcaaagttgtccaagtccaacagctcaactgaactttcctaaatggaattgttaaaaagtggtaaatttaaaaacttcccctggctcacgtggtgactcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggcggtaaaactgaaacatacttcctcttcccttgaatataaaaaagcattgtggtttagtacttttatcttggatcattgttcagaaggaggttcagcccccacacaaccacatttttattgtcatgaatggcaagacaaaatgtagagctcaacttacgcaaaggataaaaggctcaaaagacaaattatgccacaacttagcagccaaattcttaccaagtatagacttttgacatactgatctcattccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaatctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaatttttttttttttttttgagacagagttccgctccactcagtcgcccaggctggagtgcagtggtgcaatctcggctcactgcaacctccagctcctgggctcaagccattctcctgcctcagcctcccgagcagctgagattacaggtctctgccaccatgcccgactaatttttgtatttttagtagagatgaggtttcaccatgttggccagtctggccttgaactcctgacaggcgatctgcctgcctcggcctcccaaagtgctgggattacaggtgtgagccaccgtgcccggccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagcgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctggcaatacatgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagttcttaaaaagtaacaaggtgggctgggcgtggtggctcacgcctgcaatcccagcactttgggaagccgaggtgggtggaccgcgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaaaattaccaaggtggagatcatgaaaatggcatgaatagcgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccgtacaacaatggtaatgatttcagaaacatggtgttgagcagaataaagcagacacaaaagagtacctatggcatggcatgcatctgtatacgcgaaattccagaataagcaagctaagctatgataagaaagagactggctgggaagagtgagagttcactttctggggtgacataatagtgtagatcttggctgggcacggtggttcatgcctgtaatcccaacactttgggaggccgaggcaggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattgccccattgcactccagcctcagcaacaagggagaaactgtctcaaaaaaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcagatcacgaggtcaagacatggagactatcctggcgaacacggtgaaacccagtctctactaaaaatacaaaaattagccaggcgttgtaatctgagctgctcaggaggctgaggcaggaccattgcttgaaccccggaagcggaggttgcagtgagccgagatcttgccactgcactccagcctgggcgacagaatgagactctgtcttaaaaaaaaaaaaaaaaaaaaaaaaaagtcatcaaaccagatgacacaaatgaaatgacatttcactttgttttggtccgttttgtttgttagagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcagccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggcgccctgaggcagccaggacagaggtggaggtggcttagggcaggggggagggaaggggacggggaccgggcccgatctgagttggggagggggaggggagggggaggggagggggaggggaaggggaggggaaggggggaagtaagggaagggaaaggaggagaagggggctgttggggaggaggaggaggagaagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattaggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccttctcagtcccccacgctcctcccaaggccaggtcctctctggaaccttcacaaacctgatttctggtcctccccaaccagctccctgtccctgcttctgggtgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaaccgagtgatgatgtccttatctatatcatcttactgcccgtgtgtgtggactttaaattctgaacccaaatgagggggagaaaaccaagctgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctcagctaaacttcccacaggccttctgcccgatcacacagagtgtgcccaaactcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaaacaggggctgggggtggtggctcacgcctgtaatcccagcactttgggaggccgaggtgggcggatcacaaggtcaggagttccagaccagcctggccaatatggtgaaaccctgtctctaataaaatacaaaaattagccgggtgtggtggtgggcgcctgtagtcccacctacttgggaggctgaggcaggagaacagtttgaacccgggaggcagagtctgcagtgagccgagattgcaccactgcactccagcctaggcgacagagcgagactctgtctcaaaaacagcaacaactacaaacaaacaaaaaacagggttaacaaaactatggaattcaattctatttatatgctgcagccatgttccagccctagatttggctgggcatggtggctcacgtctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaatcccagctactcaggaggctgaggcaggacaatcccttgaacctgggaggcggaggttgcagtgagccgagatcgtaccattgcactccagcctgggtgacagaatggaatgagactctgtctcaaaaaaaaaaaaaaaaaaaagaagaagccctagatttcggttgtgttggttgtaaaaggagagacccagtaagtgggggtcatgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccaggtggtgtgaccacatggagccacagacacccagcaaggacacgcagcccgcacacccccggtactccagacacagtgacctgcaccagggctcgaggtttctctagggaacccacctcttagaatcatccagaaacaagtcactcttcatctgtccagcaaaggcctgctgagaggtgcacagggtcttgagtccaagctgcgccaaggcggcaggacccccagtagagccctcacctcagcgtggaggcctgagaacgtgaggaaggagctgtccagcacggatgagtccaggcagctgtcgacgtccagcacctgctgcccggcaggtgtggggctcgggctcccagccacctgcaggacaagggcagtggtcagcgggcggcagctcagacctgctcaggacagggatgagaagccacctcctcagcagacaggacagagcccggtgccatctgacagaatgtcctagaatgctagatatatgggacatctgcaccgtccgtgatggcagcccctcgcgacatgtgccactgaacacttgacagcagactggtgcagctaaggaacagagttttaaatttcattttttttttttttagatggagtctcgctctgtcacccaggctggagtgcactggcgcaatctcagctcactgcaacctccacctcccgcgttcaggcgattgtccgtcctggctcagcctctttagtagctgggattacaggtgcctgccacgatgcccagctaattttttgtatttttagtagagacggggtttcactgtgttggccaggctggtcttggaactcctgacctcaagtgatctgcccgcctccgcctcccaaagtgctgggattacaggtgtgagccaccacacccggccatcgttccattttaattaacttaaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcctgggcttttctttgtgggattttttttttttttttttttggagacggagtcttgctccgttgcccaggatggagtgcagtggcgcaatctcggctcactgcaagctccgcctcctgggttcatgccattctcctgcctcagcctctcgagtagctgggactacaggcgcccgccaccatgcccagctgtttttgtatttgtagtagagatggggtttcattgtgttggccaggctggtctcgaactcctgacctcaactgatctgcccgcctcggcctcccaaagtgttgggattacaggcatgagccaccgtgcctggccctttttaatgttttatatagatggggtcttgctatgttgcccaggctggtctcaaactcctggactcagatccgcccacctcggcctcctgaagtgttgggattacaggcgtgagccaccacacccggcccggccactgggaggtttctaagggactaactcggcctcttcacttgctatagatgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggccctgggcatggtgccgaggcccaggctccattcccagtactcccgggtccccagccccagcccaccttgctccgggacatccggaagagaaagaggatggccaggtagacgggatagacaaccacgctggacaccaggccaacagcgactgtgtcgacgctcagcgggttcagcctggacacacgccccgtgctgtgtggaggagaggaggccacacaggtgaggctgaggggcaggaagggctgggcaggaagaggctgtcccgacccctacggcacccacctgtaggcagagtctccaacagccccgtaccacacggcgttggcgcccaggaagagacagatgaggagatcgcagcaggtggccctctggatgcgagtgaaacagctacgaggcggccggtcccatatggagagccagatgtgcttgtcaaagaagccacgctgcagctcagccaccagcaggcgccggaagcgcaacagggctgcgtgacctagaaggcagggagggccgcactgcaggaggccacggggcaggaccaccctgcccaacctcccacggagtgggaacacggaacgaggccttactcgcggccagcacctccttctccaccaggcccccgttggcctccgtctccaccgaaagccagtcattgaccaggaagaaggtgctgcgtgccgtctgcaggtccctgacgatgatgtgctgcaggaaccaggcagggctgagccctgcagaggcgcgggagggaggtcaggttcgcagggcgccccaatgcaggggcagaggggcagagcttggcagggtccatacagacctttgttgtcgtgccacactcggatcttccacatgctacccaggctgtgcggggtggcgatctggaagatgtccagactgttgcggtggaaggctctgtcgccgtccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacagctctgctatacacgaggagctgcggttactgcaatttgtccaataaacagcaggacctcaaggacatgattaagttacatggaaagaactgtaacttgtaacatgcaaacatggctgcacacgcctcagtccacaccacaaccagtgacccgcactgcacacctgtccacacctcagtcacgccacaaccggtgacctgcaccacacacccgtccctcagttcatgcacagactgcgaagcgtgaagctgtgtcacctcctctcccagtgacagacccaggtgacagtattttttttttttttttttttgagatggagtcttgctgtgtcacccaggctggagtgcagtggcgcaatctcagctcactgcaagctccgcctcccgggttcacgccattctcctgcctcagtctcccgaggagctgggactacaggcgcctgccaccacgccggcctaatttttttgtattttttagtagagacagggtttcaccgttagccaggatggtctcgatctcctgaccccgtgattagcctgcctcagcctcccaaagtgctcggattacaggtgtgagccaccgcacccggccgacagtttttaaaagtaggtaatcaaaagaaagaactgggaaatgaagatgaaagcagcatggaaataaaaaatgggaacacggccaggtgtggtggctcacacctgtcatcccagcactctggcaggccgaggcaggcggatcacctgaggtcaggagttcgcctggctgacatggtgaaaaattaactgggtgtggtggtgtgcacctgtactcccagctactcaggagaatcgcttaaggggaatcgcttaaacccaggagctggaagttgctgtgagccaagatcacgccattgcactccagcctgggcaacagagcgagactccgtctccaaaaaaagaaaaacgaaaacaaaaagggaatgccagaagggcaattccaaagaaaggaaaatggaggtattgaagaaacagccacggggagggtgctggcgcctccgtctgagagacgagctatgcagtcaggatcgcgggtggatgcatggtctcccacagtggtagcgatgctcacgtaacttgtggggctacgctactgtgtagaacgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgcctgcgacgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcagccccggctggcatccaactggtccagcttgtgcaggatggcggccatgaccatgtaggtcaccaggcacacagcacatgtcagcatgacgatgtagtttacatccgctgttggctcctgtgaagacacagccgccaggcccaggaggtcacgtgcaagctgtgccttctcaggatagagccgagcccacccaggccctcctcgactctgcagaggctcccaggagcacagggtcactcacaggaaacacaaagcggatatggcttgggggcacgaagaggctggtgccgaaggcggtgaggtggcgggtgaggcagacggcctggcggggcgaggtctcctccaggggcagcagcccctctgtccgccacaccacgtcctcctcgctgaagtactggcacagggacgtgtacaagcccacggacacctccagcgccgaccagcggaagtggctggagaggttcagacggtaactccccactgggtctctggtcctgggaagggaaggggcagtggacgtgagcccaggctccgccaggttggatgtcggagtcccagagcccatacccggtccagtcccctcgctgcctgccgtccccacggggcccgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgcgctcattgggccggggctccgagtgcaggtagactgccaggtagggctcgggttcctcagacaggtagcggcctggggcagaacgcgcaggtcacacgcctgccgggaagctcaaccacccgggggacacccacgatggccctcctgagcccaccctctgccatgggcctgaaaggccataggagcctctgcaccagagctggcacctgcttctccgtggcccccagctcctctccggccaggcccccagcagcccatgaaacagaaagcaaatttcaccagagacacccatggaagccctacgagaaacgccttccccccaagaacaaggccagggggccgcgtgtgccccaaccgctgcatgcaccgtccagcagcgtatagttgagctgcagatgcagcacggccgcagggttgctgctgtccagggtgaccacagcaccgacggaggcctggggctggaccacaacggagttggcggagctgcggtggccccgggcagcccagtccgagttgttgggcaccttcacggtgaggcgcgctctgaggccagccgctcgatggggatctgggcgccggcctgtgtctggaacgccatcgaggccaccttggtggagacggtgtagttgctgatatagccaaagggaaagggattggagtccaccagaaagatgagctgcaccacgtcactgaggttggccggggccctgctgaaagcctaggggatggagaagtggcagccaggccctggggcgccgccatagcacagcaggctccgcgggtccgagcgcttgccctgggccacgatctcctcacccgccagcgtcaggggctcctcgttgagcacgcgggagcgcgtgacgatgggcgtgagggcagaggtcaggttgtaggcctgggacgccaccatccgcgatggtgactcggctcccagctctgagcgctgtggtgcccgcacgtctgagctggccaggtggatgaggtctcctgcagacaggcgtgaggtcagtgcagagacagggaggcagagggagggtgggggcaggcaaaaagggggagccggagggtggggactgggagaaagggggaacctgagggggcagagagcgaggtgcaggcagaaggaagagggaagctggagagagagtggtggagggggagggggaaggggatggggatgaggacgaagatgagggggatgatggggagagggaggaaaaaggaaggaaaagggtagagaaaagagaaaggggagaagaagaggagcagggggaaagggaggggaaggggataagggggataagggaggggaagggggataagggaggggaaggaggataagggggataagaaagatgaggggaatggacaaaaggacggggaggatcgggggggaaatggagaaaaggggagagagatggagaaaagggagggatgaggtgaggggaagctctaggggaggggaggaggggaagggctaggggaggggaggggctaggggaggaggcaggggctaggtgaggggggaggggctaggggagggaagggggaggggaggggttaggggagggaaaggggaggggaggggctaggggagggaagggggaggggaggggagagtggagggcacagagcagcatcttcttagtccctccccacatctgggcccctctttacaccctgggtcccccgagaggcaccctgcgttcacacaggacagcagaaaggctgaggctactgaagcaggtcagagaccgaggaacgccacggcaggaaggagcccaggctggaggctcagctcctcggccaagctgcccgtctgccctggggggctgaacccagtaccctggcaggcatgcggggcggggtgagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcagggggcacagcaagctgtcagcagggcaggaggccggcaggaggccagcagatgcccacgactcccggggtgcagttacgtgctagatgctgtgtgatgtgggcactgacccgcaacactgagctgtttcttcatgggcaaaacagggtaagcacatgggccctcctgggcgggggctgcattgtggaaagcagacaccggagagggcccggtgggtgtggctgctgggagcggaacgtcggggtgctgcttcagggtcactgggatttatctctggggcccgggatgagccctccgcaaagctccaggcaggggaacaggtcttggtccccagcacgcatgcagcagatgtgaggtcccctcccaggctgcactcacctcgttcagcacagtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctatgagcagagggggttggtgagcaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgctcttgtagacacagaactctttgcagtggccctggcaacagcgctgcagcagcagggcgtacaccagcggggcgccagcatcctccgcgtcatgccagcctgagggatggtccccacagcatcacgggagggctccgtgacgtcacagagtcgggggatcccgctgctccccctacgcaggcctgcactcacccgtgcattcgaagtgcaccttggtggtgagggcgtgcacagcgcccagtgggaagaggcggcaagagccctccagcggcgggcggttgggggacagggggatggaggcacagccctcctcctcgccagagcggcccagcaccgtcagcgtgaaggtgtatccctcgccgtcccgcagcacgccccgccgcagcaccagtcacatgcctgcgctgcccgtggatgtggtggtctcatccagcaccagtgtcttgttgctgaacgtacgtgcagcccaccgctgcaggcagaagggatggtgaggggtcgcaaccctctgccctgtcagccccacttctgcctgcaggccccgtcccctcggccatgggacccatccccaacccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactccggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgtgttctggtgtactggacccagctggaccctggcaggaggcaggcaatgctcactgagggcccctggggggatgcgtgtgggaacagacgtatgtgtgggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggcccgttgaggaaagcagggactggggaacagacacccactctggggcaccagcaggccccgcctgacagcagcaggagcagccaccatgggctcagggtcaccaagcctcctggccggtccagagtggggagcatgagggtgagaaccggcccaccacatccagcaacagggacatgggctggggacagtggctgcctctggggtgggaaggggctcttcctcactgttggtattgctgggggactgtgtagcttttgtcactagagcatatgtggcttgaagactgtatgtggaactgtggcaggtttggaaggaagcaaagctgaagcaggctgtcgtgttacatagaatttgcatcagaaacagagaggggagagcgcgcggcctccaccagcactaaaacacggaaaacagtagatgagcagggaggctgggctgtccaaggcaagtggccgaggggcgggcggcacccaccgtctggttggtggcctcctccttgcggccggccttccacacggtgaggctgaaggtgtactccacgccagctgccagccgttcccgtggaatggtgaccgtgctgctcccgcggggcccaaagttcagcgcacacccgccagcctccctctgcaggccgagaacaaggggcgacgtggcccgagaaccccatccagttttaaagcagagcccggcccaggagacagtgcgggagaccccctccccatgctgggacggggcccaccaggcactgaggacgggccagccctggtggcaagctgggtgttctctgggctcatgggtgtggacgggtgaggggcagggaggacggccctgccacgcactgacctgtgtcgaagccacacaggcccactggaaactgagcggcgtctggtcgccgtcctccaggttggggtcgtaggactcgctcccatccagcaccaggtcctgtgtgtctgaccacacgcggtaggagccaccctcagtgatgggcaccaggcgctcgggggccaccgtcacattggcctggatgctccgtgccagtggcgtgtccccaaatgacacgacaaacacaaagcagtagtgccccacaggcagcgccagccacggcagcaccagctgaggccggctcacgtccacgccgggcagggccacacgcgccgggcgccccggccgctggcagctggcggtgcggtacacctcccagcggtactcagtctggtaggtgacacagtcgcgcaggtcaacgtaggcatccaggcagttgcgctgtgatcgtcgcatcagcacctgcaggggcaggaccacgtccacctccggctcccggcaggccagcacctggacggtcaccgtggcctgcgccacgaaaaagctcaccaggttggaggcgttcacctgcacgcggtagtccccaggcctcaggtaggagtgctcggccctgggctcatctgtgtcctgccctggggacccatccccaaagtcccagtggtaggccacgcgccgggggctggggctggtggcggcctcaaactgcgccgagcggttggtgaagcaggggccgctgcgcagggccacatactggacggcgtcctgaacctccagcaccagcgtgcggttctcactgcccagggcgttgaaggcacgcacctggatctccaacagccccgcggccacggcgtgtaggtgacgtcgcggcccgacaggatgaacagagagtcgccccggaccttctgcagcgagaagtaccaggcgtaggcgacccgagagccgcgctgcacgcgggctgtgaagttcctctcagtgcccatggcgatgccaggctcacagcagttgggcacctgcagcccgctcacggcctccagcaccacgatgcgcacctgcgcctgggcccagctcacgtggtttttgccctgcacgctcaccacgtggtctccgatgcgggggaagctgtgggagaaacggggcccagggagcacttcggggctggccccgccgacctgcaggcggaaggtgacagctgagccggcagccagcaggatctgaaaatggacaagctgcccgggcgccaccaccttgctgctggcccacagcaccaggcccacgatgggctcctccaccgtgaggttgtacgtggctgagacccagctgactgcgttggaggcattgagccagatgttgaaggtgccagcatccgggaagaccatggtgacatgagggccacgcttgctgctgccgccgggcacagcccagcaccagctcacattggtgcccgtggccagctgcccccaaaagggcacagaggacccggccgccacgaagctgcctcccggctcgctggccctgatgctgaggccactcacaggcacctgcacatccacttccacggtggcgttggctgagcccagcgggttccctgccgtcatggtgaccaagtgcaggccgggtgtggggaagctgtgggtggtaaatggctcgggggtctcccagctcagcccctcctccaaggaccaagtgtatacgacaccactgccaccagccagctcggcactgagggtgacgcttgtgttgacggcagctgggttcggggaggcggccaccatcagccaccccacaggctccacgaagtccacggtgcagtcagcccaggcgctgcccagcatgttggtggcccgcagctgcacatggtaggagccggcctcgagcgcggtgagcgagaagcctttgccgctgccggccagggccgggcccctgtccctccaggcagtccagctgtaggagatggtgccgtccctgaccacggcctgcagctgtaccatgtggttggtggggaagtagcggccaccgcccaccacctgcagcccctctatgagctgcaggacatagacgaagatgctgtcctgggcggagcccacctcgttctcagctgtgacgatgatattgaaggtgcccacggagcggaaggtgtaaagagatggcaggacccccagagatgggcgtgcagcggtcacagagcacccaggaatagcgcacatcactgccggcctccagcgaggtgctgaagctcatgctcccattcaggggcaccaccgtgcagctggcattgacgatgagcccccgcacgcgccgcttcaccgtcacattgagccaggcctcgctgcggctcacctcattgcagccggccaccctaacggtgaagtcacctgtgctgttgtaagcgtgggtgacctccggaccctcgagccgcccaccgtcccccagatcccacaggtagctggcggggcgcccacggcccacagcagagaacaggtacggctgctgcagctccagcccaagggagccattgaccttgatgctggtgaccagcacgggctcctgcacctccaccagggctgagtcattggcagcggagatgttgttggacgcggtgactgtcacaagataggagcctgggtctcggtagatgaacgtcacctcagggcccccgacacgggcggggacggcttcttcggtgccaaagtcccaggtgtagcggtaggggaacgggggccaggcacatgccaccagccgggcctcgtccccgagctgcacaaactgcctctctggctgcagggtgacgttgcccacctctggctccacgcagatgctggtgaagtaacgcgccctgttcacgcggctggacagcaccagcgccagggggaacgtgccgctacgcgtgaagttgtgtgtcaccgtcgggcacccccgcatggtcgtgttggaggagccatccccaaaggtccagtcgaagaggtagcgggccgggttcccggtgacgtaggccgtgagccgcgcgtcaggctgagtggggatgcaggcggcgggctcgacgcgcagcacctccaggacgaagaccagcacgtgcaggctccgggccaggtggccggcggggctggccgcacccacggtcactgtgcagttctgtgcccgcaggtacacatgctccactgtggcctctgggcccgacagcacggtgccgtcccccatgtcgaaggtccacgtgatgttgtcgcccgtctgcaccgcggcactgaccaccacgggggcgccctgctccacggccaggctcatgtccacgctgagcccgcggagctcctcaaagacgcgcacatccgcctgggccgccgcaccgctcaccgtgttgttgacctccaggcgcacgtggtagatgcccctcgagggataggtgtggttggcagccggctggctctgggtcaggacaggggagccgtccccgaagtcccacgtgtaaagaacacccccaggcgagggcagcagatgcgggtagaaggtgacgggccggccggccaccaggacgccgtcactcacacccacagcctcggagggcagggaggcgcgcacgctcacaggcacctgctgcatccggttctcgaaggcattagatgccagcacggtcaggacgtactcacctgtggggacaggcccaagtggggcagccgcggcacccccacctgctccccacccgctcggcagaagccccccgcctgaggagcccggggtgaacggctgcacctgcggcccagccttaagggtcccaggctcccaagccacgtgcgggacggagcacaggtgcagcagcactgagggctgcctggtgaggacggcaccgcctccaagtgcagctgcactcggggcagcagagcagcaagagccaggccgcggcggggggcagttcagggggcccagcttccctgtccactccccccacgcctggcccctccctcaccccagtagggacctaagccatcagcccaggtgaggtcacagtgagggctgttggggaggaaggggggcagcttgactgggggactgggggtgccccgtgctcagagcctgaaaggcagtggccccctcaccccctcatccctcacctggggcagcgtaggtgtgcgtgacattgtgctccaccagcacctgggccaccgaggggtctggaactgggaaggactcgttgtacggaggctggaactggtggagggcctgctccccatccccaaaggtccacctgccggggcggtgggaggcagtgagtgaaccgggacaggggtgcgcagtggcggggcacaggtgcgcggtgggggggcagggggtgcttgggacccagctgaggctccactctgcagtcacgccccgggcctccattcagggcccacccggctgtgctgaggcctctcccggctcccgtgcagcctcagggctcctgtgcacccagtacctcccaacagatagggaaaccgaggctcagaaaagcaaccccctgatgtggggtccctcggctgaggctggggccgggacaagagcctggtgcccaccccaaaccggcccccgagtcactcacaggaaggccacctccacagccgagtccaccagcacgcccgccgtcagtgccagcgtggcattgggggacagcacggccggcactgtggagacccgcaggccctgcatcctgttcatccgctccacggtgatgttgtagttcacggtgacgttgctcacgtggttggaggccgtcagctgcagggataggcatcagtgggcccaggtggcaggtgagaggcctggccctgcttagcgtccctccctccactcacccacagccatggcagcgtcctcgggcagcatgaagcagaggtgaaggtggagcccgccccgccccaccccatcccctcccctccccacccccgcccacctactgagagcttgaagaccgccgcgctctgataaatgacattgaagaccacgttctggaaggtcagggactgcttgtcgttgatggtccaccggaagaccatgtccgagccggcctccaccacggggctgtacctctgcggggggactggtgtcagcctgggctctgtggaggactctgcccttagcctgtcgcctcctggacacacctcccgtcaggctggagagtcccacgcggggcacagaggagaggaggtggccggggctctgcatgccatgggagccaagcccgggctgggacactgactgtccggctctccagccagccatgtagtactactaatgcctcaacctctctgtgcctcagtttccccatctgtaaagcaaacctagtaccagctacaaagagtccacctctctctgagtcttctcagaccctcccggggctcctgccccagctcctcagccagagagctcggagcagtgaggggaggcacacgggcctcacagggacagcacctacactggcttacagaacccaggacaggctgcacaggtcacgccatttctgatggcccctcccaaggcccctggtgaaggggcaggtacccgcaagacggagacagccctgtcccccatgtacccagcatggtggcaccgcgggcagcccgcagtttcccatcaggggttcagactccacctcaaaagccactcgctttagccaggtgagaacacagcagagggcgtgagagactcacgggggctcgtgtgaggtcagggagcggagttttaaattcatttcatgaaatgagacggtggaatgagttagcggagccgctgtcagagccgtgactttccaggaatttaaagcccaccaggtagcctgaggagccagccagcaggacctgcccggggccgacgtccccagtaactgggctgctgccctcactgggaagccaggcctcacgccctgtgtgagcaccctgtctgcaggcacctgcctgggggctggtggtggagcctcggccatactcaccactgggactccctgcagtacacgggcctcggggctgggcgtggcgcggaggccacagatgggctcctccgccgtcacccgcaggctgaggttggcccggctggcgctgttttccaccacaacgtccatcacgtgctccccctcaccgagccacggcagtgctaccactgagaacagggtatcattggtctcccaggggcagccgggcacgaaggtggccaccagggcagggcaggcattctcaaagcgagcgctgacactgcccccaggccagcgagccgtggccgtggcgctggcaccagagtccacctggagcaccgaggctgagccgttggtgggcacgtagaggcggccgtcgcggggggcagggtagatgacccgcagcccagccactggggagaccacgtcaaagctgcaggacaggttgtgcctggacacgccattgcccacctctgcccggacctcatagcgcccaggcagccgcagcccagggttgggcctcaggcccagcagcacggtgagctgttccgtggctgcaagcagccgcagggcacaggcagggcaggcccaagtgccctccagctgggctggcaagtggggcagccatgacgaggcgttggcggagaggtacggggcctggggaccagggtggccgggagccggcgagcagtgcgggagggcgccagggccagcgtcgtgctgcaagccaacgaggtcaccagggagcatgaggacatcctggccgtggagggtgacctgtggagagggaggcagggctgcatcacgtcctcacggtcatggcccgtggacccctgcacgacggatgagggtggacacgcagggctccccgcttcgtcagccacacctcagggagcctccccacagtgctcgtgacaaggacaggcaggacagttgcagacagggggacacacggggagaggacacaggccaagacctggcagacaggaaggagcggctgtgctgggagagaggaagaggaggcacagctcgtgccaagggcccaggcgagagcttctcccactgggagaggggcaagggcactgcagaggtcggaggttggaggtcggaggtcggaggtcagaggtggcaaggacgtgggaggggcctgcaggctgggtgtgtctgctgcgcagacccagaccctgggcagcagacaggaaggtggcctgaggagatgcagggaacagacccaggtcagggccacacaccgagtactgcgcggggggccccgcgggaacggagaagaggaactctctccatagcgcatagggggccccgagtagccctggcccctgacgtgcagccattggcgcaggcctggggtggcaggaggcgtccagcggcaagcagatgttggctccagggcaccagcgtccccctggcatgcacgcgggggccagctgggtcctgttgtccggggacctgctctcaggctcgctgccgttctccggggtccctgcgaggaggggagggtgttggggccctcattcgcccacgggccaccgtcagagatgcccaactgcctgcaccagcgagcctggccttgctgtgaggacaggtctccccgcccgggcagcactcccagcccagtgctgcgtccctgtctccggccagctgactgacccaggccggtccccaggcaggccccacccgatccacccccaggacacctggaatgagctggtgtctctggaacccctgctctgtccacctaagactgggaaccactctgatggccacaggaccagcagacgtgagagctcagagaggccaccccgagtcctgcggcgcccaccaccccagagtcccacctgctgtgctgaggagccggtacacctgcagccgcagctgggcgggccgccggagctcctgggtcccaaattcggccgtggtgaggaaggcttcacggctcagacgcaggcccgggaataccatgacctggtgggcagggggccgcctcagctccacagaccccatcccagcctgaagcccagactccccccacccgaacttcccaggaagaggggagggaaggagagcgagccatcggacccccacaggcctggctcctgtcgctcgagaggaagactccgatggaaactgtccatggggggcaggacccctgacctgcctttcaggaataactcacccacactcagagaaaagggggtaatgtgagtaaacgctttcctctctgcactctggattttcccaaccatcttcactgggcacaagcaacattaaggcccccaagttttttggggagacccacagtgggcagggcaggcgaggcctccaggggcaggcaggagggcaggttttagaacgtggggggccgactacctccacgggctcatgcggggctgagaggccgtcctgccgtgccagaggcatcaggggtccctgcaggtccccactgggcgctcccacgaggaggttctcggcatcctgcactgggcctggggtggcaagtgcacagtgaggcgccgggccagggcccaggacaccaggacgaacagactggggaccgagccgcccgagaacccccccaccagcccctcctcctcagcccaggctccaccgcgggcgctcggcaggcccctaaccacagccagcgtctcaggcccctgcctggcccctcgcacacctccaggccgcagctcgcagacgtagctgtgcggcgctgagcacaggtcggtgttacaccacccggtgggcccgagccggacgcagtgctcggctgtggctgggtgtggctccccgggcagccagttctggcagctctccaggctgaaggcctcgccctgcggggctgggcccacctccaccccctgcacagtcgagaagccgatccacatgtctaggctcctgggggcgggtgtgggatggcagggggctcagggcactcctccatcctcccaccctcacagcagcccactgggagccccgtcactgtccccctttccagatggggaaactgaggctcagagcccggagagcagggcccaccagcccaggctcacagcagcacccacccacgaggcctgtgggcactggcagggatccccgtgcaggccacctcccgtatggcgtgcccaggagtgtccggaggctgcccccagctcgtgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtgggggcaggcacctggtgacccgggagaccaggaagcgctgcatggcgggactgtccaccattgccagggcggccccggcccaggcccgacactgctcctgcgcctgcagccaggccgccttctccaccaccaggcggtagcagtgcccgttgccagagaagatctccgtgtccgaggggcagagcgggtgcaccgctggagaccggtgggaacgagggtgtcaacggtcagtgtgggcccaaaacgggggtaccaggctctgccccatctggatggccctggggaggaaggggagtgggcagcagacactcacctcgggccggctcctcgcccagggccacgatgctgtaggcggcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggcccccagggccagcacggccatcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccagggtggcccctggggaggcagggaagacgtgctggaggagggtggggcccctacaggtgggggcaggaggcggcggggggccggagcagagggacaggcaggcgaaggaggcactggagggctgggctgacccacacaggcaccagccctgctcggagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacccccccatccgcccgccgcactcacaggctcccatgctgttcccttggcccggaggccccccccagagaggccttcctgagccctgcccagtgtctgcagggcccaggtcccacctggctgggaaggacagagctgccccacccaccggcactcaccacagccactgtccagcaaggggatgccaagcagaggctggccagccagggagccaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacggaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacatttccagcatccccaagctaaggcctcccacccttgagctccccactcccagaggtcaggaggggcctttctgatggaagacccaaatgaacactcatctggggaaaccaagccaggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaggaaggatcgcttgagccagggaggtcgaggctgcagtgagctatgattgtgccactgcagtccagcctgggcgacagagcaagacccagtctcgaaagaaaagaaagagaaagcaagaaaagaaagatggctgggcacggtggctcactcctgtaatcccagcactttgggaggccaaggtgggtggatcatgagatcaagagatcaagaccatcctggccaacagggtgaaaccccgtctctactaaaaatgcaaaaattagctgggcgtggtggcgggcaccagtccaggctactcgggaggctgaggcaggagaatggtgtgaacccaggaggcggagcttgcagtgagccgagatggcactgctgcactccagcctgggcaacagagtgagactccatctcaaataataataaaaaataaataaataaataaataaaagacatcactcacacctgtaatcccagcacttcgggaggccgaggcaagcagatcacctaaggccaagagttcaagaccagcctgaccaacatggtgaaaccccatctctactaaaaatatttttaaaaattagctgggcgtggtggcgcgcgcctgtaatcccagctactcaggaggctgaggcaggagaatcgcttgaacccgggaggtggaggctgcagtgagccgagatcacaccattgtcctccagcctgggtgacagagccagactccgtctcaaacaaaacaaaacaaaagacatcagctagctggtccaagcacagtggtgttcacaacgaattgatcacagccaggtagaattcttcattctttctccagttccactgctttgcttgaccagccttaaagacacacatatacatttttgtctgggcgcgctggctcacacctgtaatcccaacactttgggaggccaaggcaggtggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgccgtgagctgagatcgcgccactgcactccagcctgggcaacaagagcgaaactctgtctcaaaaaaaaaaaaaaaaaagtatatatttttaaaagacattggccgggtgcggtggctcacgcctgtaatcccagcactttgggaggccgaggtgggcagatcacgaggtcaggagatcgagaccatcctggccaacacggtaaaaccccgtctctactaaaaatacaaaaattagctgggcacggtggtgcatgcctgtaaacccagctaccaggtactcgggaggctgaggcaggagaatcacttgaaccagggagtcggaggttgcggcgagctgagatcatgccactgcactgcggcctggagacaagagcaagactccgtctcaaaaaaaaaaaaaaaaaaaaaaaaaaagacatcaactaattgcagtgtgtggaccttatttggctcttaattcaaactattaaaccaaaaatgtgaacacaccaggccttcggtggcatgaaggaattgtctgttgtgttaggtgggtctgcggtattgcgatgccctccaaaatgcttgcagataaaagggtggctggaatttggttcaaaacatgggtcagggctgggcgtggtggctcatgcctgtaatcccagcactttgggaggccgaggcgggcggatcatctgaggtcaggagttcaagaccagcctgaccaatatggagaaaccctgtctctactaaaaatacaaaattagccaggcatggtggtgcacgcctgtaatcccagctactcgggaggctgaggcaggaaaagcgcttgaacccaggaggcggaggttgccatgagccgagatcgtgccattgcactccagccttggcaacaagagtgaactctgtctcaaaaaaaaaaacaaaaaacacatgggtcaggaggggaagggtcggggcagggagggcagggcaggctctggggtggggggtctgtgagtcagccacggctctgcccacgtctccccacgaagcttcgagccatgcagagcagcacgttttgcagtacgccatcttttccaaaagccaccacctctcggcagcatccttaacccaaggcaggctgtggcctcagaagccccggctgtcctccacctggaactggacacagctgtccctgctgagcttcagcagccagggagccacaagtggagaggcacctgcgtgagccccccaggaaggctactggtgacacccagacagcaacgctcctggacccttgaacacctgccagcagctgtgatctgtgtccttcacctctcccagcttgacccctcttccctggggaaaacccagccgtctccccgaggaggagtttgcagggtagacagcaaaatggctgggctgccccacagcacagagggtggcctggggggccagccagggccttcacatccttcctagggccctagtttcccatgggtcccctcaccccaccttccagaactctcccagcggcggccccaggtgtgtacagaacagcacccacctgcccacgaggtcaccctgtgccctgttgcacacttgaggggcctggcattcggaatcttgccagctcaggctgggacaggccaccaacccccagggtccccctcctccaaaccccaggaccagagcctaagaggacaacacaaggcaggggcgggggttccactgctgtgccaagggcctggagaacacgggccttgctctccgctcagcagccaccagcgcccttctctcccggacagctcccgaggggctgctctcatggacaccatcaggtgctgggaagcaggaaccaccaggacctggacagagtccccagtgaccggcctggcagacagaggagccctcagctacagcatcacaaacaacgggtggggtaggtctgatgcaattctgtgggtgctgttgccaggcaggaggaggccatctccacagagacagccgcgagacacacgcgtccgcagtcagggagcgcaggagcaatgtggccccgaggggcacgggctccattggtccaggagaacccattcttctcccaccctcgagaccacccagcaaagccccaaggacacacggctcccctaaggaagggtggccacaggcgggagtgacccagaaacgttacaaaaccaaatgccagaacccatccaatgtttagaaagcctggggatgtgccacgtcccccagggatccagcacgcacccaaagagacactgtcccggcgaggagcctggagcctgggaaatacaaggcatcagactggtaccaagactctccccagcgctggggacaactgtctgcttatcttagtcccctgcgcccttttcaatccaaccctgggtcctgggcacctcatagttccaaacccctgctatgcacatcccggctgtgatgcctgggacaggtcctgtcctggctgtgatgcctgggacaggtcgtgtcacctctccaaacctgtttcctcatctgtgaaatgcaaatctccacggtccctatgcctcggatggtcagagtcaggattccgcatgacgacccccaacaggagcctggcacagacctggctctgggcagcgtctccataaaggccacctgttgtttttatctcccgaaagcgaacatgacaaggctttaaccccccacggcaatccgccctcacccctgttctcaggatagccttggaacccaatagcagagcgcctgaggcccttcatgaccccagcccacccgcgagcccacctcccaccctgcccctacccctcacacctcccgtggccagcctccagcctcacggtctttgctcacaccgttcaccccccttcttctggacccacctcatcgccccttcctaagcatcagcccaattcttgcacatccatcaaatccttgtccagacacctcctggaactcttccctgcagccccctacagccatccccatctctccgggtaccccgcagccccaggccgaatcccaattcctctccaattagcgactgtttgtcctcccagctgagcgcggcctccgcgccccgcccccgctggcgtccgcagagcccccgggtgggacgtctgtctccagacccggggtttttcggctccccggggccgtgccaaccgcggctccaggcgttccttatttagcagggccgctgtgccgcgccggagcctcgccctgggagcgtcctggcccgcgtcctgcttcccgtcccgggccagggaacgcgcccacgcccgcccgtcccgcggcctctcccgggtgccgctgggcccgctactcacagcgctgtggcgtccgcggggatgcgcagcgcgggaccgagcgtccgcagcccgcggcccgcggcccgagcagttgacgcggcaggcggcgccgggcgctaggccgcagaggcaggggggctcgcaaggcccgcagccgcgcccggggccccccgccagcgccccgagccacaggcccaggcccagggccagcgccaggcgggcgggcgcggcgggcggcatcgttagggcagcgcgcgcatggccccgccgtccccaggcccgcccgcgcgcggaggccgcggctcaggcggggccggcggacggcatggcgggcgcggggctggatggggctgcggccgcgacctgctgctgagcgacgcccgctcggggctcggggccaggccgctccgggagctcggccgcccgctcggacgttggcgctgcagtgcgggccccgccgcggctcctcctcctcctccccgcgcggcgcagggcggacggggcgagggggggcggggcgggtgcaggctccgcccccttcgccacagcgcgaccgggccagcgatgagggactggcatccggaggcttcaccctccgctccacagggtcggcagcagggcggggcctccggaagctccgccccacgctttcccggggcgcatgcgacgtggggcggagcgtctggaagctccgcccgtcgcactg
